United States Patent 11,739,335 (NUCLEIC ACIDS ENCODING CRISPR-ASSOCIATED PROTEINS AND USES THEREOF) - sequence listing, part 12

SEQ ID NO: 9096 - RNA, 4209 nt, Artificial Sequence
  Cas9 variant
augggcaagcaagaauuuaaugacuauuacuuaggcuuugauauagggacaaacuccgucggaugggcuguaacagaccaacaauacaaauuacuccgauucaacaaaaaagauauguggggcagccgguuguuugaagaggcaaaaacugcaaaagaaagaaggguguacagaaacuccagacgaagacuagauagaagaaaaagaagacuaaaacuacuggaagaacucuuucucgaugaaauacuaaaaguagacuccacauuuuucaagcggcuagaagaaucaaacuuauacaacgaagacaaaagcaucaaauucaauuaccccuuauuuaaugacaaagacuauacugauaucgauuucuauaaggaauauaagaccauauaccaccuaaggaaggcgcuaguauucgaagauagaaaguucgacauaagacuauuauucauagcccuucaccauauacuaaaauauagaggccacuucauauuugaaggacaaaguuuugaagauauaaagagcuuugacuauaucuuuacagaaauccaagauuggauauuagaaaauuucgaaauaaacauagacauuaaucuaaaagagaaacuagaagaaauaauacuaaguaauaacaccaaaaguauaaaaaaaauagaauuuaaaaaaauuuucucggacaaucguauacucgcuauucucaacaugggagucgguugcaaagucgacuuaaaagauguauucaacaaugaagagcuaaaagaucagaaaaucucauucacagagauugauuacgaaaaugagaaaagggacgaauuuuaucaacuucuaggagaaggcauauucaucguagauuuagccaaaaagaucuacgauuuuaugguccuaaagaaaauccucaaaaauuccgacuacuuuucagaaucaaaaguugcauuauaugaagaacauaaagaggaucuaaacagacuaaaguacauauucaaaaaauacuuaaaaagcagcgauuacuauaaauucuucagaucaaacucagaaaagacuaacuacccgucauacaucggacuaaacaaaauaaaaacaaaaagacuaauugagaauaacaaaugcucgaucagugacauuaauaaagaacuaaaaaacaaauaccuaaaggauauccaaguugaggcagaagacgaagaacuuuucaaccgcauacuacauaaaauaaacgaaaacaaguucuuagaaaaguuaaaaaguucugaaaacaguaccgugccauaucaaguacacgaaaucgaauuaaaaaaaauccuagauaaucagagaaaauaccauaguuuuuugaaugaaaaaagcgacggaaugacacuuugcgaaaaaauaaucaaacuguucgaauucagaauaccauauuacguaggcccauuaaacaccaaccccaacaugaauaaaaaaaacaaaaacacauggguugucaaaaaagaagaaaacucaaaaucaucaauaacacccuggaacuucgaaaaaaaaguagaugaacaaaaaagcgcagaagaauucauaaagagaaugacaaauagaugcaccuaucucagaggagaagacguaauaccaaagaacagucuccuauacgaggaauuuguauuacuaaacgaacugaacaaaguaacagucgacaaugaacuucuacacccaacacuaaaaaaugaaauaauagaugaacuauuuaagacaaccgucaaaguaacgaaaaaaaaaauuacagaauuucuaaaaaaaaaacaagcuauaucagacgucgaaucaaucacagggaucgacguagaauucaauggaaaacuacaaggauauaacacuuuccguaaaauuuuaggagaaaaaauagaaaaucucaauauuaaaaaauucguagaacguuguaucgaacuaaaauguuuauacggaucagauaaaaaacuuuucaaaaacgcagucggcaaauuauauaaagaauacaacguuaccgaugaagaauuuacaaaaaucaacaaacuaaauuucaacaaauggggaagauuaagcaaagaauucuuaacuggaauuagauucgaaaaaaccgacggaacugaaagauuugaaucgguaauagcugcucuaagaaguacaaacuacaaucuaauggaauugcuaucagacaaauuuaauuugcaaucaaaaauagacgagauaaauggagaggacgacuucaguaacauugauauaaaagaauauguaaacgaauuguauguaucaccaucaguaaaaagaucuauaauacaaacauauaaaaucgccauggaaaucaaaaaaauaacagggaaaaauccuaaaaaaguauucauagaaauggcgaaaggaggaggugaaaaagggaaacgaacugaacgacgaaaagacaaaauaaaagaacuguacaaaaacaugaaagacucucuguccgauuacugcaauaaucuucaagacuuaagcucgcaagucgaaaaauaugaugauaauagguuaagacaaaaaaaauuauuccuauacuucaugcaaaugggcaaaagcauguauaccggaaacgauauagaccucucagaacuauucaacaauaacauauacgauaucgaccauaucuacccacaaaguaaagucaaagacgacucauucgauaauauagucuuaguagaaaaacaagaaaaccacucaaaauccaacgaacuguuaaaaccagaaauccaaagcaaaaugaauaacuauuggaucuucuuaagagaaaacaaauucauaucuaaagaaaaguauaacagacuaacgagaaaaaaaaacuuuaccgaugaagaauugggagacuucgucgcaagacaacuaguuaccacaagacaaucaacuaaagaagucgcaaagcuauuugaaaaaauauucgacggaaccgaaguaguauauucaaaagcaagucuugucucagauuuuagggaacgauucgacauaauaaaaguacgggagguaaaugacgcccaccaugcacaagaugccuaucuaaacauagugguagguaauguauuuaacacaaaguucacaaaaaacuauuggaaauucauaaaagaaaacaaccguaagaacgaagaaaauccaaacaaaaaggaaggauauaacuuuaaaaauauauacgaaagcgacguauucagaaaugaagauguugcauggguuuucagcaaagaaaauaaggaaauuaauacgauaaaaacagucaauaagaugguauacaggaaaacaguaaacauaaccgaaauguuaguagagggaaaaggccaacuauucaaucuuaccauaaaggacagaacacaacugaaaaaaaagguagguaacaucgucgcaaauaucccuaaaaguuuaaaaaaccgaaauacaaaguuaaaaagcgacgagcuagcgaaaaaguacggauacuucgauucuuuaaacaacagcuauuuuguauuauucaaauacguugagaaagaaaaagaaaagauaggauuugacggaauuacaauaguugacaaagaaaaauuaaaaaagaacucagacauagaaagauuucuagaaaacaaaggcaacaaaaacgcuaaguuaauaagaaagaucuucaaaaaccaaaaaguacugaucgauggauacccauacuuacuaaagucauguaacaaagacaaagcuauaagauucgacaacuucaaauccuuauaccuagacgaaaacgaccuaaaauucacccgagacgccauuaaguuugaaaaaaauaaugcagacaucgacuuaaagaaacagaaauacauuaucagcuucuuaaaaaaaaaaaaacaaaacgaaaucaacgaaacuuacgaggaguguauugaaaggcuuaauaaugaauucgauacauuauuucuaaaucuaugcgacauccaaaaauccccaauauacaaaaacuacaaauugccagacuucauaagcaaaaaaaaugucgucgaaguaaaagauaaguucgaaguguucaaaaacuuggagcuauauaacaaaucaaaauuaauaaagaauuuucuuaacuacuucaaauacgauaauaauaaacuagaccuuauagcuauuggcauagauuccaaagcaaacugcauccaaaaacauuucacagaggaccuuauaaaagauuucguaauaguagaugaaaguguuaccggacuuuuugccaagaaggaacgacuagaauga

SEQ ID NO: 9097 - RNA, 4209 nt, Artificial Sequence
  Cas9 variant
augaccuaucgcaauuaccacauuggccucgacauaggaaccagcagcguugguuuugcaguacgcuacgacaauggggaacugguccacaagaaagggaguaaccucgugggagcacggcuauucaaagaaggugaaaccgcugaagaaagaagacugaaucgaggagcuagaagaagauauaauagaagaaaauggcgccuaaaccugcuaaaucaaauuuucaaacccuuaauugaaguaaacgauccaacauucuuuaaacgacuggaacaaaguaauuuaguaaauuacgauaaguccgaaucauuuagccuccucaauaaccaaucagacgacaaacuccaccaacaauucccaaccauuuaccaccuuagagacuaucuuaugaagucaaccgaaaaagcagacauacgauuaauuuaucuagcuguccaucacauaguaaaauaucgaggcaacuuccuagaugcaagcccaguugacucauuugaagcuaguaauuugaaaguagacgaaauuuuaacacaaauaaaccuacuguuagauaaccuuacagaugaccuucguuuaaacacccaauaugucacagauauagaacaaacacugcugucaaauaccgaaucaaauaaagacaaagaaaaaguaauccaaaaacuuuuacuccacaaagaagccaucaaaauugauaaggaccgcacagcacaaaucgcaaagcuaguucuaggauauaaagcagacauagccaaacuauuuggaauaacagaaaaacuacaaacuccaaaauuagaauugagugcagccaauucggacgaugcacuaauggaacuaagcgccgaauuaaacgaagaucaaauuggaauuuuacuacaacucaaaacauuauauucaaggguaagacucaaucaaaucauuccuaguggcacgucucuuaguaaauccaugauagaaaaauacgaacuacaucacacacaacuuaaaucuuucaaagaaaauauacuacuaaaacugcggcguaacacggcaguacgucgcaaucucgaacuagcauaugcauuguauguaggcaacgcccaaaccaaacaagagguauuugaaccuaagaaagcaagauucacuucugaugauuucgcaagucuuaaagccaacgcuaaaucagcaagcagcgucaaagaagcacccaaaaauacaaaaacgaaacuaacaacagacgacuuuuacaacauacuuacugaacuauucgccaccuucgaauccgaacuaucugccgacgaagacaugaucaaagaaguagaacaaaucaagaaagcaauuaccggagacaauuaccuuccaaaacaaagaacagaucaaaacggaaacaucccacaccaauuacaucaaauagaacuaagacaaaucuugcaaaaccagcuaccacacuauccagaaauggacaaaauaaaugagcaaaaaccaaucgaaaaacucguaacauuccguguuccauacuauauuggaccccucaucaccccugaagaccaacaaaaaucaagcgccgcgaacuucgcauggaugaaacgaaaagaacaaggggcuauaacccccuggaauuucgacgauaaaguagaucgcaugcaaagugcaacaaauuucauaaaaagaaugacaguaaaagacaccuaccuaauaaacgaagacguacuaccagaccgaucccuauuauaccaacguuuuaaaguacuuaaugaacucaaucucguaaaaguaaacaaccaacuguuauccauaggcgaaaaacaagcaauuuaccacgaucuguuugaaaaacagaaaaccgucuccacaaagaaacuccaaucauaucuacaaagugaacaaggauacggagacaacaucgaaauaagcggccuaucuaauccagauaaauucaacaacggacuaacaacauacaucgauuuuaaaaacaucuucggagaccuaguagaggacacgacaaaacaaaaagaguucgaacaaaucauagaaugguccacuguauuugaagaccgagcaauuuuuaaagcaaaacuccaagaaguaaacuggcugacggaagaacaaauaaaagcauuagucgcuaaacguuacucaggauggggccgacugaguuaccgauuacuugcagaacucgugaaugacaacggugaacgcauaaucgacauacuauggaauaacaaaggaucgaaucuuaugucaauagucagucaagacgaauuucaacaacagauagcaagaaucaauucgcaugaaguacaagaacuaggaauggaaucgguuuuagcuaaugcauacacaucuccacaaaacaagaaagcaauaagacaagucaugaaagucguagacgacauacagcuugccaugaauggacaagccccaacaagcauaucgaucgaguucacacggaaacccgaagaaaacucagaaauaucaaaaagcagauaugaaaccauaacuucgauauaucagagcuuaucgaaagacauagaaaaagaaguaaaagauaacuuaaacaaaaacaaauccucacuaaagaaaaaccucagugacaaauacuaccuauacuuuacucaacucgguagagacauauauacuaaucaaccaauuccauucaaugaaauaccuuacuacgauauugaccacauagucccacguuccgucgaaaugaaugacucacucaacaauagagugcucgucgcuaaaagcauaaaccaaauaaagaaaaacaaugccccuauugacucuucucuaaaaauaacaucagagacaagacaauuauggaagaaauugcucgauagcggcuuaauaacuaaacaaaaauacuauaaauuaucaucuucuaucaaaaacacaguaagucccuacgucaaacaaggcuuuauaaaccgacagcuaguagaaacaucccaaguaauaaaacucgucgcgaauauuuuaggaaccaaauaccaaaacgaugacaccgaaauuauagagguaaaagcccauuuaaauagcgaaauacgaaaaaccuuugaguucuacaaacucagagaauuaaaugacuaucaccauggauucgacgcguaccuaacgacgcuaguaggcggcuaucuauacaacagauaucccaaacuacgcagcuacuucgucuacggcgaccauaaacgacuagauaaagcacaacuaagugaacugaaaaacuucaacuucuugcauggacuaacaaauccuaaauccgggucggauggauuaauaacagccagcgguucucaacaaguaguucucgaucgaaacgaaacaauuaaaagauuaaauaaaauauaccgauacaaauacaugcucauauccagagaaguauuuacuaaacaaggacaauuuuauaaugaaacaauauacccugcaaaaccaaauacugcgaaaaugauuccacugaaagauaauaaaccaucagaaguguacgggggauacucaaguaguaacgucucaaaaauagcacuuauuaaagagaaaaacacugacaauuaucaauucauaggcaucccuaucagauccauugcaaaauuaaaacaagccaaagcaaacucuaaaacagucuaccaaacugaauugaacagaguaauuaaaagcgucuuagcaucacagaaaacuaagaaacaaaaagaguucgaaguaauacuagacaacguaaaauauaaucaaguagucguagaccaaggagaaaaauauuaccuggggucaccuuauuauaaaaagaacgccaaacagcuagucauuagcccagaaaguguaaaaauauuagcggauaaagccacagcggaccuacccgaacaagaagcacacaauaaacuuaugacaguauaccaagaaaucguagacguacuaaacaaacauuuugcauuauacgauaucaacaacgugagaaagaaauuaaacgacggucuaauuaaauucucucaacuccccaacuacgacgaaacgaguaaaaauagauucgacauauccaaaaguaucaaaaccaaauacgcagucauuaugagaauauuaucaggaaucaaaaaucaaacaagcgaaguacccgaauuaggccuuaaaucgccauuaaacaaaaugcaaacuaaaggaggcaucaaaauaucaccagaagcaaaaauauacuacucuaguccaacaggcauauucagucacuuuaaacaagugaaaaaucuauga

SEQ ID NO: 9098 - RNA, 4209 nt, Artificial Sequence
  Cas9 variant
auggaacguauucuagggcuagaccuagggguaucaucuauagggugggcccuaguagaagaagaugugaaaaacccagaaaacaauaaaauuauaaaacuuggagucagaguuaauccacuaacaauagacgaaaagacaaacuuugaaaaaggaaaaucuaucacaacuaaugcuggccgcacaagcgcaaggagugcacggagaaaccuacaaagauuuaaacuaaggcggaagaaauuauuagaaauacuaauacauuauaagauaauaaagaacgaugccguccuggcagaaacugguaaaaauacaaccuuccaaacucaauaucugcgagcuaaagcagcaagagagaaaauagaauuggaugaauuagcaagaguacuauuacuuaucaauaagaaaaggggauauaaaagcagcaggaaaguccaaaacgaugaugacggaaaagcaauagacggacuaucaguagcuaaagaauuauaugagaaaaacuauacaccgggacaauacgcauaugaucuacugaaaagagguaagaaacaaauaccagacuucuacagaucagauuuacaaaacgaacuagacagaauaugggaauuucaaaaacaauaucauccagacauacuaacggacgaauuuaagaaagaacuagaaggaaaaggacaaagagcaacagccgcuaucuuuuugaacagauauaaaauauacacugccgacaauaaagggacaagagaagagaagaaaauacaggcuuaucaauggaggguagaagcgcugucgcagccacucgacguuaaagaagucgcauauguaauagcagaaauuaacaacaaccuaaacaacucaucaggcuauuuaggagcgauaucugacagaaguaagaaacuauacuuuaacggacaaacaauuggcgaauaccuuuuugaagaacugucggcuaauccccauacuagacucaaaaaccaaguauucuaucgacaagacuaucaagaugaauuugagaaaauuuggaaaauucaaacuaaauuccacccagaauuaacaaaagagcuaaaagaacaagugagagauaucguaauauuuuaccaaagaaaacuaaaaucacaaaaaggacuaaucucuuuuugcgaguucgaaagcagggaaauagaaaucgaagaaaauggaaaaagaaaaagaaagaaaguggguuuaaaaguagcaccaaaaucgucacccuuauuucaagaauuuaaaaucuggcaaguauuaaacaacauagaaaucaaaaacgaagaugaaagaagguaccuagaaccagaagaaaaagaauugcuauucaacgaauuaaacuguaaaggcaaccuaacaucacaaaaaugccuggaacuauuaggauucaaaagcaaagacgcgaaacuaaauuuuaaagugguagaaggaaaccgaacaaacgaaaaauuauacgacgcauuccuaaaaauacucgaacuccaaggauacaacguauucgaauuacucaaaauuaaagaagacaaagacgaagcaaaacuaagcgaacugaaagcauccgccgaugaaauuaaaggcaugaucaaagaaaucuucaaugcaaauuuaauuaauacauccauauuggacuucaacgcagaacucgaaggcaaagacuuugaaaaccaagcuaguuaucaauucuggcaucugauguacuccuaugaaggcgacaacagcccaucaggcaacgaaaaacuauaugaacuuuuggagaagaaauucggcuucaagaaagaacauucaaaaauucuaagcacaaucguauuuagccaggaauacggaucguuaucuacgaaagccaugcgcagaauauacccauacaucaaagauaacaaauauagugaggcuuguuuacucgcaggauauaaccauucaaaacauagccuaaccaaagaagaauuagagaacagaaaacuuaaagaacaauuagaaguacuacccaaaaacagccuaagaaaucccguaguugagaaaauauuaaaccaaaugauaaacuuagucaacgcaacaauuagugaauacgggaaacucgauggaguaagaauugaauuagcgagagaacucaagaaaagugcacaggaaagagaagacauggcuaaaaguaucaacgaagcaacacuucuacaccaaaaauacgcaaccauauuaaaacaagaguucggaguaguaaacccaagucguaacgauauaauaagguauaaacuauacauggaacucacaguuaacgguuacaaagauuuauauaccaauacuaaaauagaaaaagaaaaucuauucacugauaaauaugacauagaucacauaauaccccagucuagauucuuugacgacucauuuucaaacaaaguucuugugcccagacaaucuaaccuagauaaaggcaaccuuacugcguaugauuuuaugucaaacaaaggcagcgaaagggaagaacacuuuuuaaaugugaucaaagaacuacuggacaaaggaagcauaucuaaagcaaaauacgaaaaacugaaaaagaaaggauuggaaaucggagacggguuuauagaacgagacuugcgagacacacaauacauagccaagaaagccaaagaaauauuauucgaaauaacaaauucaguagugaccacaagugggcgaaucacagauaaauuaagaaaagacugggaucuugucaacauaaugaaagaguugaacuuagauaacuacagaagacuaggucucacggaaauaguccguaacagcaaaggagaggagaaagaacucauacccgacuggacgaaacgaaacgaucauagacaccacgcgauggacgcauugacaguggcuuucacaacccggaaucacauacaauaucuuaauuaucuuaaugcucgaaaagacgaaaaacauaaagaacaccaaaacauauacgccaucgagaauaucaucaccgaagucauagaaaagaaaaacggaucaaaaacccgaagauuuaaagcgccaaugaacucauucagacacgaagcaaaacaacaccuaaaagaaauucuagugucacacaaaaccaaaaauaaaguaguaacuucaaauauaaauaaaaccaaaaagaaaggaggaauccauaagaaaacagagcuaacucccagaggacaauuacacaaagagacaguauauggauccaagaaauuccuacagucgagagaggaaaaaguaucagcaaaauucgacuaugaaacaauacuaaugguuguaaacccgauacauagaaacgcucucuuaaacagauuaaaagaauacggcaacgauccuaaaaaggcuuuuucagggaaaaaugcaaucaauaagaacccaguauaucuagacgacucgaaaaccgacauauuaagcgagaaaguaaccuuaucaugguacgaaaccggauacaccauaagaaaaucagucaccccagacaacuucaaagauuacaaaaacuuagaaaagauaaccgauuuaggaaucaaaaagauacugaaagaaagguuagaccaauuuaaaggaaaugcaaaagaagcauucaguaauuuagauaaagacccaauauggcuaaaugaagaaaaaggaauagcaauaaaaaccguaacaauaacgggaguaaguaaugccgagaguuugcacuuuaagaaggaccauuugggaaaagaaauauuagacgaaaacgggaauaaaauuccuggagacuuuguaagcacgggaaacaaccaccaccuagcaauauaccucgaugaagaggaaaaacuagaugauaagaugguaacguucuaugaagcaguacuacgaguaaaccaaggacuaccugucauagauaaagacuacaacaaggagaaaggcuacaaauuuuuaaugacacuaaaacaaaaugaaauguucguauucccaaacgaagauuuugacccuaaugaaauagaucuacuagacgaaagaaaucuagaaaggauauccaaacaccuauuucgcguccagaaaauaagcaaaguaggcuauggcaauagcuucgucagggauuucgucuuccgccaccaccuagaaacgacaguggaagaaagaaaagaacugcgaaacaucaccuacauacaacuaaaaagccucgaaggccuccgcaacauaauaaagguccgacuaaaccauuuaggaaaaauaguacaaauaggugaguacuga

SEQ ID NO: 9099 - RNA, 4215 nt, Artificial Sequence
  Cas9 variant
augaccaaaaauauacuaggauuagaccuaggaguaucaucgauagguugggcacuuguccaagaagacaguaaaaacccagaaaauaaccgaauaguaaaauuaggagucagaguaaacccuuuaacaguugaugaacaaauaaauuucgaaaaaggaaaaccaauaacaacaaaugcaagccgaacacuugcaagaucagcaagacgcaaccugcaaagauucaaauucagacgagcaaaccuaauugacguauugaagaaauguaacauuuuaaaacaaggggaccuacugacagaaauagguaaaaauucaacauuucaaacccaggaacuaagagcaaaaagcgcuaaagaaaaaguagaacuauccgauuucguacggguacuacuucucaugaacaagaaaagagguuauagguccucaagaaaagcuaaaaacgaagacgaaggccaaauaauagacggaaugucuguagcuaagaaacuguacgaagaaaaucuuacaccaggagaauacagcuaccaacuauuaauagaaaacaagaaacaacugccugauuuuuaucgcagcgauuuacaaagugaguucgaucgcguguggaaauuucaaaaacaauuuaacccugaaauacuuacggacgaccuauauaaagaauugcagggcaaaaacaaaaaugccacuugggcaguauuaaaagaaccguuuagccuuguaggaauuaaacaaauugguaccauccaagaaaagaaagcagaaaaauacuuuuggaggucagaggcuguuaaaagacaacuggauuucgaaaguuuagcagucguuuuccaagaaaucaacagcaacuuaaauaauucaucaggcuacuuaggugcuauaucagacagaucaaaagaacuuuacuucaacaaucaaaccgucggcgaauaccuauuucagcaauuaaaagaaaacagccacaccaaacucaaaaaccaagucuuuuauagacaagauuacuuagaugaguucgagaaaauaugggaaacccaaagcaaauacuacaaagaacuaacaaaagaacucaaagaagaaauaagagacauuauaauauuuuaucaaagaaaacugaaaucacaaaaaggucuuauauccauaugcgaauuugaaaauagggaaauugaaauaacagaaaacggcaaaaucaaaaagaaaacaguaggacucaaaguagcaccaaaauccuccccucuauuucaagaguucaaaaucuggcagguacuaaauaaccuagucuuccaaaguauugaaagcaaagaacuauuuccacucgaucuagacaucaaagaauccauauuuaacgaaguaaauauaaaaggcaauuuaagugccaaaaauguauuagaucuaaugggauacucagguaaagaauggaaaacuaauuuuaaaaauaucgaaggaaaucguacaaaugaaaaccuauacacugcuuuucuuaaaauaauagcguccgaagguaucgaauuuccaaaagaauuuaaauuaucaauugacgaugacaucaaaguauccaaaauagauauaaguagcgagaaaauaaaagaguucaucaaagaaaacuucuuaaaauuaggaauaaauacgucgaucuuggauuucaauccugaauuagacggaaaagacuucgaaaaacaagaaaguuaccaacucuggcauuuauuauauucauacgaaggagacgacucagcaagcggcaacguuaaacucuacgaacuccuagagaagaaauucggauucaagaaagaacacuccaaaauucuagcggacguaggcuuuucacccgacuauggaucucugagcuccaaagcaaugcgcaaaauauauccauauauuaaagaaaauaaauacucagaugcgugucaccuagcagguuacaaccauagcaaaaacucauuuacuaaagaucaacucgcaaacagaauccuaaaagaacaacucgagauccuuccuaaaaacgcucuacgaaacccagucguagagaaaauacuaaaccaaaugauaaaucugguaaaugaaguaauaaaagcauacggaaaacccgaugaaaucagaaucgaauuagcucgcgaacugaagaaaaaugcagaagaacgugccaacaugacaucagacauuagcaaagcuacacuacuacaccaaaaauacgcagaaguucuacaaaaagaguucggcaucaaagcgccauccagaaaugacauaauacgauacaaauuauacuuggaacuugagaaaaaucucuuuaaggacuuauauacagauguacaaauaaaaagagaagaauuauucacugacaaauacgauauugaucacauaauaccucaaagcagauucuucgaugauucauucuccaacaaaguccuaguaccuagaggagcaaaucuaaagaaaggaaauuuuacagcauuagauuacauggaaaucgaaggcaaagaaaaacucgaaaaguuucuaaauauuaucaaagaacucuucgacaaaggcgcaauuagcaaagcaaaauucgaaaaacuucagaagaaaggaucagaaauaggagaaggauuuauagaaagggacuuaagggacacccaauacauagccaagaaagcaaaagaaauacuuuucggaauaacaaacucggugauuucaacauccggcagaauaacagacaaacuaagagaagauuggaacuuaguaaacacaaugaaagaacuaaaucuagagaaauacagaaaauuaggacucacugagcuuauuguaaacucuaaaggugaggaaaaagaaagaaucauagauuggacaaagagaaacgaccaccgccaccaugcaauggacgcuuuaacagucgcuuucacaacccacaaccacauucaguaucuaaauuaccucaaugcucgcaaagaugaaaaacacaaagaacaccaaaauauauuugcuaucgagaauacgauaacugaaauaguagagaagaaaaaugguucgaaagaaagaagauucaaacuaccaauaaagaacuucagaacugaggcaaagaaacaauuagaagaaguccucaucagucacaaagccaaaaacaaaguugucaccaaaaacaucaacaagaucaagaagaaagguuccauuauagcaaaaaccgaauuaacucccagagggcaacuacacaaagaaacaauuuacggaucuagcaaauucuuaaaaacaaaagaagaaaagauaucagguaaauucgacuuagaaaugauacaaaaaguucaaaaugaaaaauauaggaacgcacucuuaaaacgacuucaagaguucgguggagauuccaagaaagccuucacaggcaaaaacgugauaucuaaaaacccaauauuccuaaaugcagaaaagacagaacaacuaccggaaacaguaacccuagcaugguacgaaaccggauauaccaucaggaaagucgucaacccagauaacuucaaagauuucaaaaacaucgaaaaagugauagacaaaggagucagggauaucuuaacagaacgucucaaagaguucaaugguaauucaaaagaagccuucucaaaccuagagaaaaaucccauauggcuuaacaaaucaaaaggaauaucaauaaaaacgguaaccauaacuggaauuaauaaugccgaagcccuacacuauaagaaagaccaucucggaaaagaaaucuuagacgaaaauggccaacgaaucgcagucgauuucgucaguaccggcaauaaccaccacguugcuauauaugaagacgacaacggaaaucuucaagaaaaaguaguaucauuuuaugaagcugucgaaagaguaaaucaaaaccuaccaauuauaaacaaagaauauaacuucgaacuaggauggaaauuccuauucacaaugaagcaaaacgaaauguuccucuuuccaagugaugacuuugacccaaaagaaguugaccuauucgacgacaaguaucuaucacuuauaaguaaaaauuuauuccgaguucaaagcaucucaauagugcaauauggaaacaguguaauuagagacuuuaaauucagacaccaccucgaaacuagcguaucagacgaaaagaaacuucaaggaguuacauaucaacaaaucaaaucucuacaaccacuuaaagauauaauaaaaauaagacucaacaaucucggaaaaaucgugcaaaucggagaauacuga

SEQ ID NO: 9100 - RNA, 4215 nt, Artificial Sequence
  Cas9 variant
augaaagggaacaucgagaagaaaaaacaagaauucaacgacuacuaccuaggcuuugacauuggcacaaauagcguaggaugggccguaagcgaucuaagcuacaaccuucuacguuuuaauaaaaaagacauguggggagcuagacucuuugacgaagcaaagacggcaaaagauaggcgaguaaaaagaaacucaagacgacgcuuagaaagaagauccaaaagauuaaaauaccuagaagaaauuuucgaaacagaaauaugcaaaauagacaaaaacuuuuuuagaagacucgaagagaguacauuacacaaugaagacaaaacauucgauuuucgauuccccauauucaacgacgaaaauuauacagacaaagaguauuauaaagauuuccccaccguauaucaucuuagaaaugagcuuauuaaaaacgaaaacaaaaaguucgacauacgccuaaucuaccuggcaauacauaauauccuaaaguauaggggucacuucaucuuugagggccaagacuuugacucagucaccgauuucaaagaagucuuuagcgaacuaucagcuuaccuaagcgaaaacuuggaagaaaacuuagacauaaaccuaugcgauaacauaaaagacauaauauguucaaaagaaaacaaaacaagcaaaggaaaaagcuucguaucacucaucgacuccaaaguaauccaaucaguacuacgguguuguauaggauaccgcguaaaauucaaggauauuuucauaaauuaugaagaaaaagaaaaaaaugaggguauaaaccucucagagaucgaauacgaugaaaaacgcgacgaaauagcgcuaucccuuggcgaaaacauauuauuaauagacaucugcaaaaaaguauacgacuuuaugauuuuaaauaauauauugaaagggaacaaauacauaagcgaaucuaaaguuaacuuauaugacgaacacaaaugugaucucuguaaccucaaauacaucuuuaaaaaauacuuaccaaaaaaagauuauuucgaauucuucagaaacgaaaacaaagaaaaaaacuauguaucauauauuucaucaagccuaaauaauggaaaaaagaaaaacaccugcacacaagaagaccucaauaaagaaauaaaagaauauauagcaaaaaucaaggaguacgaggaaaacgaugccguucuagaaaagaucaaccuaaaauuaaacgaaaacaaacuauuaccaaaacugaaaacgaacgacaacggggucauucccuaccaaauccauaaaauagaacuagaaaaaauacuccagaaucaaagcaaauauuaugacuuuuuacucgagaaaauagacggaaucacaaacauagaaagaauagaaaaacuuuucacuuuucgaaucccauacuauauaggaacacuaaaagguaaauuuagcugggccaaacuaaaagagaacaaaaaaauaacaccguggaauuucgaaaaaauagucgacauggaagaaucagcuaaagccuucauagagagaaugucaaacagguguucguauuuaaaaaccgaaaacgucuuaccaaaaaacucacuccuauacucugaauaugaacuccuuaacgaacugaacaagguaaaaauaaaaaacgaauucaucaaugucgugcucaaaaacgaaauaauagaugaauuauucaaaacaacauccaaaguaacaaaaaaaaaauucguugacuaucuuaagaccaaacaaauauucguagaaaaagaagacauaucagguuuagacaacgaauucaaaucaaaacuugauagcuauauaaaauucaagaaaguaaucggcgacaaaaucgacacauuacgcggauauaacuuuguugaaaaauguauagaauucaaaugcuucuacggagaugauaaaaaacucuucaaaaacgcaauaaacaauacggaauucaaagacuacguuagcgacgacgaauuaaaaaaaauaaacaaaaugaaauuuaacaaauggggcagauugucaaaacgacucuuaacagaaaucugcuucgaaaacguuauugaaucagaaucuuuugaaaauaucaucguagcccucagauccacuaauuacaauuucauggaauucacaagcaaaaaauucaaccucagugaaaaaguggcagaggaaaaccaagaaaacacauuagaaaaauuuaacauuaaugaauauguggacgagcuauacgucaguccaucagucaaaagaagcaucauucaaaccuacaaaauagccauggaaauaaaaaagauaacaggaaaaaauccaaaaaaaauauucauugaaauggcaagaggaggaggagaaaaaggcaaaaaaacggaaaaacguaaagaaagaauuaaaacauuguaugcaaauaugaaggacagcaacgaagaauuucuuaacaaucuagacaauuuaaaacucuccguagacaauuacgaugauaauagguugcgugaaaagaaauuguuucuauauuucaugcaauuaggcaaaucuauguacacgggaaaaaauauugaccuaaacgaacucuuauucgcuaauacguacgauaucgaccacauuauuccacaaagcaaacuuaaagaugauucauuugauaacauagucuuggucgagaaaacaaucaauaaggacaaagacaacagagacuaucuagacgagaguaucagacuccguaugaacaaauuuuggaacuuucugcgggaaaaaggauucaucacaauagaaaaauauaaucgauuaagacgcaacacauacuucucagacgaugaacuaucagguuucauaucccgacaauugguuaccacaagacaaagcacacuugaaguaaaaaaacuguucgaauucauauuucaaaauacagacguggucuguucaaaagcaaauuuagucuccgauuuuagagaaaaauacggcauaaucaaaguaagagacuuaaacgaugcacaccacgcccaagacgccuaucucaacauaguaguuggaaaugucuucgauacuaaauucacaaaaaacuacuggaaauucaucgaagaccgaaggaaaguagauaacauacgagaaacauacaacuucaaaaaaauauucgacuaugacguguccagaggagaaaacguugcguggcuaaaagacuacucaauuaacacaauaucggagaugauaaacaaaaaaacggcaaacauaacacaaaugauaacagagggaaaaggccaacucuucgauuuaacaauauuaaaaaaaaguaaaauugauaaaaaacuaaccguaauaccaaauacaccuaaaauacuaaaaucuuccuuaaaagauucguguaaaauagcagaaaaguauggguacuuuagcacacuaaugccagccuacuuuguuguguuuaaauacauugacaaaaauaaagaagucuucgguuuugacagaauauucauauuugaucgcgaaaaaauuaacucaaacgaagauauagaaaaauaucuagaagacaaaggauacaacaguccaaaguucauaagaaaaguaaauuuaaagcaaaagauacuacuaaacggcuaucccuacagaauaguagguuuuacagacaacaaacuagagauaaagaacagcaaacaauucuacuccgauggggaacaccucaaauacaucaaacacuuaucagccuuuuacaacaacaauaacaacguuaaaaacggagaauacagaauuaacuuccucaaaaaaaccagcgaaaaugaucgcaaugaaaccacagaugaagccaaagaacgacuuaacaucgaauucauaaaacuauacgaauauuuuugcgaaagauuaaacaguaagauauaugccaauuauuacaacucaaaaaaauacgacgaacuaauagaaguguucgauuguuuuaaaaaccuaaaccuucucgacaaagcaaaauuacuccuagaguuccuuaaaauauucaagaaggacacuuacggaaauuuuaaauuacucgaaaaaccagaacuagauaaaaauggaaaacaaaaauuagacaaaaauggaaaucuaucauucgaaggauugagcauggccuuugggaaacuaaacggaaaaaaguucaaacaacuagucgaaaaagauauccaauuugucgaugaaagcguaacgggacuauucgaaaaaaaagagggacuagagaaauggcaagacggcgaacaauga

SEQ ID NO: 9101 - RNA, 4215 nt, Artificial Sequence
  Cas9 variant
auggccaaaaaaauacuuggauuagaucugggaguaagcucuauagguugggcuauaguggaggaagaugcagaaaacguaaugaacaacaaaauuguaaaguugggaguaagaguaaacccauuaacaguagacgaacaaauaaacuuugaaaaaggcaaaccgauuacaaccaaugcaggcagaacucuuguucgaggugcaagaagaaaccuucaaagauuuaaauugagaagauugcaccuaauagauauauuacaaaaacgaaacauucugaaacaagcagaucuacuugcagaaagcggaagaaauucaacauuucaaacacaagagauaagagcuaaaagcgccaaacagaaaguggaauuaagugaacuugcuagaguuuuauuguuaaucaacaaaaaacgaggauauaagaguagcagaaaagcaaaaaaugaagacgaagggcagaucguugacggaaugucaguagccaaaaaauuauaugaagaaaauaccacaccaggagaauacucuuacgaacuccuuaaaagcggaaaaaaacaacugagugacuucuauagaagcgauuuacaagcagaauucgauagaguauggaacuuccagaaacaauuuuaccccgaaauuuuuagugacaaucuuuacaaagaacuccaaggaaaaaauaaaaaugccacauggaagauacuagaaauaccuuuuagccugguuggaaucaaacaaguaggaacgacacaagaaaaaaaaauagaaaaauacuuuuggagaucagaagcugucaaaaaacaacuagauuuugaaagccuagcuguaguauuucaagaaauaaauucaaauuuaaacaacaguucaggauaucuaggugcaauuucagauagguccaaagaauuauacuuuaacaaucaaacugucggagaauaucugcauugccaacuaaaagaaaauccgcacaccaaacuaaaaaaucaaguuuucuacagacaggauuaccuagacgaauuugaaaaaauaugggagauacaaucaaaauaccacacagugcuaacaaaagaacucaaagaagaaauaagggauguaaucauauucuaccagagaaaacucaaaagucaaaaaggacuuauaaguauaugugaauuugaaaauagagagauagaaauaacagaaaaugguaaaauaaaaaaaaaagaaguaggauuaaaaguugcaccaaaauccucacuacuguuucaagaauucaaaaucuggcaaguguuaaacaauuuacaauuucaaaacauagaaagcaaagaaauuuucccucuugaccuagacuguaaagagucaaucuuuaacgaaguuaauauaaaaggacgaauaucugcaaaagcagugcuugauguauuaggauauagcggaaaagaauggaaaaccaacuucaaagacaucgaaggaaauaauucaaaugaaaaccuauauaaugcguauuuaaaaauaauagcuaacgaaggaauagaauucccaaaagaauucaaaugcaaccucgaugacgauaucaauguaucaaaaauaauaugcagugcaggcaaaauaauagaauucguaagagaaaaauuuuccgaacuaggaauuaacacguccauacuugauuucaauagcgaacuagaagguacaaauuucgaaaaacaaaagucguaucaauuauggcaccuauuguacucuuaugacggugacgacuccccaucaggcaaccaaaagcucuaugagcuacuagaaaaaaaguuuggauuuaaaaaagaacacuccaucauauuagcagauauagguuuuccccaagaauacgguucacuaaguacgaaagcuaugaggaaaauaauaccucauuuaaaaacaggauuaccauuugcaaaaaaaagcgauaacgacacaauauuaucagcaaccgcaauggcuggauacaaccauagcaagagcuuaacaacggaagagcuaacuaaaagaguacuaaaagaacaucuugaaauacuacccaagaacucucuaagaaacccagucgucgaaaaaauauuaaaccaaaugauaaacguuguuaaugaaguaauaaaagaauauggaaaaccagacgaaaucagaauugagcuagcaagagaauuaaaaaaaaacgcagaagaaagggcaaacaugacaucugaaauaggaaaggcaacuauacaacaucaaaaauauagugaaauucuccagaaggaauucggaauaaaaucaccuucacguaacgauauaauaagguacaaauuauaccuagaacuaagcaacaauggcuucaaggaucuauauacagacauucaaauuaaaagagaagaacuauuuacagacaaauacgacaucgaccauauaauaccacaaagucguuucuuugacgauagcuuuagcaauaagguacuaguaccaagaggcgcaaaccuaaagaaagguaauuugacggcuuuugacuaucuagaaucugaggguaaggauaccuuggagaaguucaucaauacaauuacagaauucuaugauaaaggcauaauaacuaaagcaaaauaugaaaaacugcaaaaaaaaggcacagaaauaggagauggauuuauagaaagagaccugagggacacccaauauauagcuaagaaagccaaggaaauuuuauucggcauaacaaacagcguaguaagcaccucgggaagaaucacagauaaacuccgagaagacuggaaucuaguaaauaccaugaaagaaaugaacuuagaaaaauaucggaaacgaggacuaacagaaacaguuaucaacucaaaaggagaagaaaaagaaaaaauaauagacuggagcaaaaggaacgaucaccgacaucaugccauggacgcacuaacgguagcauuuacaacacacaaccacauccaauaucugaacuacuugaacgcacggaaaaacgaagaccauaaacaacauaaagugauuaguaauauugaaaacuuaaucacaaagguauucgaaaaaaaaaacgggucaaaacaaaggagauuccuugagcccauacauaacuuccgaauagacgccaaaaaacacuuagaagaaauauuaauaucucacaaagcuaaaaauaaaguaguaacuaaaaauauaaacaaaauuaaaaaaaaaggaucaaucauagcaaaaauugaguuaacaccaagagggcaacuacauaaagaaaccauauacggaaguagcaaauauuugaaaacaaaggacgaaaaacucucuggaaaauucgacuuagaaaccauuaacaaaguacaaaaugaaagauacaaaaaugcacuacucgaacgacuuaaaguguucggauacgacagcaagaaagccuucacggguaaaaacauccucgcaaaaaaucccaucuuccuaaauauagaaaaaacagagcaacucccugaaguccuuacacuagccugguacgagacaaucuacaccauaagaaagucuauaaacagcgacaauuuuaaagacuauaaaaacauagacaaaguaacagauaaaaagguacauaacauacugacugaucgacuacgggaauucaauggaaauagcaaggaagcuuucucugaucuagaaaaaaacccuauaugguuaaauaaaccaaaagguauugcuaucaaaacaguaaccauuacuggaguaaacaacguggaagcacuacauuauaagaaagaccauuucgguaaagaauuccuagaugaaaagggacacaagaucccaguugauuuugugagcacaggaaacaaccaccacguggcgauauacgaagacaccgcagggaaucuacaggaaagaguuuuaucauucuacgaagcugucgaacgcgucaaucagggacucucugugaucgacaaagaauacaauaguaguuuaggcuggaaauuucuuuuuacaaugaagcagaacgaaauguucuuauuucacagcgaagauuucaauccccaagagauagaccuauacgacgaaaaaaaccugcgauuaauuucaaaaaaccuauuuagaguacagaaauucacaguaaaagacuacuuuuuccgccaucaccuagaaacuaauguagaggacaauucaaaacuuaagggagacacuuggaaaagagaaggcuuaaauggaauaagaggaauacuaaaaguuagacuaaaucaucuaggcaaaauaguucagguaggugaauauuga

SEQ ID NO: 9102 - RNA, 4215 nt, Artificial Sequence
  Cas9 variant
augucaaagaaaauacuagggcuugaccucggaacuaccucgauaggaugggcauucguaagagaagcugaagauuuucaagaagaauccucaauugaaagaauaggagucagaguuaacccacuuacaacagacgaacaaauaaauuucgaaaaaggaaaacccauaagcguaaacgcugaccgcacacuuaaaaggggagcacguagaaaucuacagagguauaaacaaagaagaacgaacuuaauacaauuauuaaaacaguacaaaauaauaaaugaaaacacaauucuugcagaagacgauaaaaacacaacgcauucaacauaugcacuaagggcaaaagcaguaagcgagaaaauaucaaaagaggcuuucgcacgaguuuuacuaaugaucaacaagaaaagagguuauaaaucaagccguaaagccaaaaaugaagaugaaggacaagcuaucgaugguauguccguagcgaaaagauuauacgaagaagacauuacgccaggacaacuuugccuacaacugcuaaaagaaggcaaaaagaaauuaccagacuucuaccuuucagaccuacaagcugaauuggagaaaaucuggaauuuucagaagaaauuuuauccagaaauacuaacagacgaauuuaagaaagaaauagaaggaaaaggacaaagagcaacaagugccaguuuuugggccaaauacaaauuuaauacugccgaaaacaaaggaaguagagacgagaagaaaaugcaagcaugggaauggcgaaguaaagcaauuaauacacaacuuacacgggaagaaguagcuuaugucauaacagaaauuaacaacaacauaaauaacaguucagguuacuuaggagccauaagugauagaagcaaagaauuauauuuuaauaaagaaacaguaggcgaauaucuuuucagacaacuucguuacucaccacauacuagaguuaaaaaccagguauucuacagacaggauuaucuugacgaguucgaaacaauaugggaaaaccagucucgauaccacaaugaacucacuaacgaguugaaaucugaaauacgagacguugugauauucuaccaaagaaaacucaaaucacaaaaaggccucauaucauuuugugaguucgaauccaaacaaaucgaaauccaaaaagauggcaaaauagucaagaaaauaauuggucugaaaguaucucccaaaucaucuccccuauuccaggaauuuaaaaucuggcaaauccuacagaaccuggaauuuacaaacaaagagacaaaagagaaaaagguuccagauuuugaagcuaaaaaucuuuuauucgaagaauuaaauauuaaaggcaauuuaaaaggagaaaaagccaucgaaauucuaggauauaaaccaaaagaauggcuaguuaacuacaaagaauuagaugggaauagaacuaaccaaguauuauaugaaggguauuuaaaaauacuagaaguugaaggauacgacauaaaagaccucuuaaaaauaaaaagcaacaaagacgaaguaaaucuaucagaauuauccaaaccaguaagugaaaucaaagaccugauaaaaaguauauucgaauccuugaauaucaacaccgccauauuagauuucaacccugaauuagaaggaaaagacuuugagaggcaagcaaguuaccaauuguggcaccucuuauauucauaugagggagacaauaguaauacaggaaaugaugaacuauaucgucuacucuaccaaaaauuuggauuugguaaagaacacgcacaaauauuggcuaaccuaaguuuuagccaagauuacgguagucuaagugcaaaagcaaugagaaaaauauaucccuuuauuaaagaaaacucauauagugaagcauguucccucgcaggauacaaucacucauccucaauaacuaaagaagaaaacgacaaaagagaauuaaaggaaaaacuugaacuguuacccaaaaauagucucagaaaccccguaguagagaaaauauuaaaucaaaugguaaacguuaucaaugcaauaauagcagacccaucaaugggacgaccagaugaaauaaggauagagcuagcaagagaacucaagaaaaaugccgcagaaagagcagaaaugacgauccauauaaauaaagcuaaaagcgaacaugauaacuauagaaaaauuuuaacaacagaguucgguauaccaaacccaacucgaaaugacauaaucagauauaaauuguacgaggaacuaaaaguuaacgguuacaaaacacuauacaguaauacguauauaccacgagaaaaacuauuuucaaaagaauuugauguagaacauauaauaccuaaagccuuauuauuugacgacucauuuuccaacaaaaccaucugcgcgagacaagaaaaucuagacaaagguaacaaaaccgccuuugacuucauucaaucauucuacggaaaagaaaaauucgaagaauaccuacaaaggauugagucauuagccaaaaucaaagaaggggauacguucguaauaucaaaagcuaaauacaagaaauuacuccucccagaaauagagauaggagaaggauucaucgaaagagauuuacgaaacucacaguauaucgcuaagaaagcuaaaucaauguuacuugauauauguaaaacugucguccccacaacaggcucuauuaccgacagauuacgagaagauuggggacuaauuaacauaaugcaagagcuaaauuucgaaaaauauaagaaacucgggcuaauagaaauggucgagaagaaagacggauccuucaaagaaagaaucaccgacuggacaaaacgcaaugaccaucgacaccacgcaauggaugcucucacaguagcuuuuacaaaacacaaucauauacaauaucuaaauuauuuaaaugcuaggaaaaaugaaaaucauaaaaugcacggcaacgucauagccauagaacaaaaagaaaccgaauuauuagucgauagcgugggcaaacgaaaacggaaauuuaaauuaccgauaucaaacuuucgugaaguagcaaaaaugcaucuugaaaauauucuagucaguuacaaagcuaaaaacaaaguagccaccaaaaacaaaaacagauucaagaccaaaaacggagaaaaagucaaaauugaacuaacuccccguggucaauuacacaaagagacaguauacggaaaaaugaagaaauacgaaacaaaagaagaaauaaucggaucuaaauuugacgaagcuacaauccuaaaaguagcaaauuuagaacaacgcaacgcacuacuacagaggcuuaaagaaaacaauaacgacccuaagaaagcguuuagcggcaaaaacagcuuaaaaagcaacccacucuauuauggaguagacucaaaaccaauaccagaaagaaucaaaauaguauggcuagaagacgacuauacuauuagaaaagaaaucacacccgaccuaaaaauagacaagguaauagauauuggaauacgcagaauacucgaaaauagauuagcagaauuuaacggcaacgcaaaagaagcauucuccaacuuagagaaaaaccccauauggcucaaugaaggaaaaaggaucgcgaucaaaagaguaacaauaucagggguaaagaacgcagagacacuacacuacaagaaggaccaucuuggacaugaaauguuagauaaacaaggaaaaagaauacccguagauuucguaucaacuggaaauaaccaucacguugcaauauauaaagaugacaaaucagaucuacaagaaaaaguaguaucauucuacgaggcagucgaaagaauaaaucaagaauuaccgaucauagauaaaucauuuaaucacgaccuaggcuggcaauuuuuauucaccaugaagcaaaacgaauauuucgucuucccucgugacggguuugacccuuaugaaauagaucuacuaaaucccgauaacuacaaaauaauaucaccgaaucuauuucgagugcagaaaauagcgaccaaaaacuauguauuuaaccaccacuuggaaacaaaagcuguagacggagaacuacuaaagaccaagaaagacuuaucggacauaaccuaccgauucauacaaacaccagucaaccucaaaaauaucauaaagguacgaauaaaucacaucggacaaaucguaaaaauaggagaguacuga

SEQ ID NO: 9103 - RNA, 4218 nt, Artificial Sequence
  Cas9 variant
augaaaacgauucuuggauuagacuuaggaacaaacucaauagguugggcuuuaguaaaagaagcagaaaacucuaaugaaaaauccgaaauaauaaaacuagguguuagagucaauccacucacaguagacgaaaaaaccaauuuugaagccggaagaccuuugucuaccaaugccgauaggaccgcaaaaaggagcgcaagacggaauuuacaaagauauaaacuaaggcgcaaaaaucuaauagauuuauugauuaaaaaccaacuuaucgacaaagauacuccacuuacugaaauaggcaaaaacacaacucaccaaacacuggaacuaagagcaaaagcagcaagagaaagaauugaauuagaagauuuagcgaggguguuucuugcaauaaacaagaaaagaggguaucgaagcucuagaaaaguaaauaaugaagaagaaggccaagccguggacgguauggcaguagcuaaaaaacuauacgacgaaaaucugacaccuggacaguacgcauaugaauuauuaaguaaaggaaaaaaguauguaccagacuuuuacagauccgaucuucaagcugaauuuaacgcaauuugggaguaccaaaaacaauucuacgcugauauuuuggacgacgaacuauacaaugcacuuaaaggccaaggucaacaaaacucgaggaaaagauuccuugcaauaaaaggaguauauaccgcagaaaacaaaggaaaacgcgacgacguaaagcuaagacacuacaaauggagaagcgaagcaaucaguaaaaaaaucaacaucgaagagguugcauauguauuagucgaaaucaacaacgaccuuaauaaaaguucgggguauuuaggcgcuauaucagacagaaguaaagaauuauacuuuaauaaagaaaccguaggagagaaccuauggaaacagauccaaaaaaacccacacacaucccuaaagaaucaaguauuuuaccgccaagauuaccuagacgaguucgaacaaauaugggaaacccaggcucaguuucauccacaacugacgcuagcgcuaaaggaacaaauaagagaugucauaauuuuuuaccaaagaaaacuaaaaagucaaaaaggccuauuaucauuuugucaauucgaaucaugggaaaucgaaagaaaagaugaaaaugguaacgugauucuaaauaaaaccacgcaacugccaaaaagacaaacaguaggacgaagagucgcacccaaaaguucacccuuauuccaagaauuuaaaaucuggcagaauauaaauaacuuagaaguaacaaaaauaucugaaggcgcaagcaagaacaaaaaggaaacagaaacccugucagaugacgaacguaaauuacuauuugaagaauuaaacuugagagguaacuugucccaaaaagaaguacuacagauucuaggacucaaagacaaagaauacaaaacuaacuucucggaaggucuugaaggaaacagaacaaaugcagcucuguucaacauauaucaacaaauagcagaaaacgaagguuacgguuuugacugguccaaaaaauccgcacaagaaauaaaagaagaauuaaaagccguguuuccacaaauaggaauccaagccgauauacuugacuucaaugcaaaucuagauggaaaagaauucgagaaucaagccagcuaucaauuauggcaccuacuuuauucggcagaggaagacgauaaaaucaacgaagaagaccaaauaauauacggaaacuccgccguaucacugaaaaaaaagcugugugagaaauucggauuuacacccgaauacgcuaaauggauugccaaugucagcuuacaagaugacuauggaaaccuuaguacuaaagcgaugagaaagauuauaccauaccuaauagacggaaacgacuauucagaggccugugcuuuagcaggcuacaaucauucaaacucacuaacaaaagaagaaaacgauaacagagaacuacuugacaaacuagaauuauuacccaaaaauucacuacgaaacccaguaguagaaaaaauauuaaaccaaauggucaacgucguuaaccaaguaauagaaaccuaugguaagcccgacgaagugagaauagagcuugcucgcgaauuaaaaaaaagcgccgaaaaacgugcagaaaugacaaaaaguauaaaugaagcaacuagacgcaacgaagacaucaaaaaauuaaucacgaaagauuucgguauaccuaaccccacuaaaucagacguaguacgauaucgacuaugggaggaacuagccccgcuugccuauaaagacguauucacagguaaacaaauaaaaaaagaagaccucuucucaucaaaaauagauaucgagcauauaauaccaaaagcucuauuauucgacgauagcuuuaguaauaaaacguuaguguucagagaaacgaaucuaaaaaaagcagaccgaacagcauacgauuuuauagaaucagacuacaaugcaacucuagaugacuacauccaaagaguagaaacacuauacaacaacacaaaaggaacuaucaguaaaggaaaacgaaacaaauugcuaauggcucaaaaaaaucucccggacggauuuauagaacgagaccuucguaacucacaauacaucgcaaagaaagcuaaagcaaugcuauaccaaguauucaaagaugucaauguaaccagugguucuauaacagaccgccuuagggaagacugggauuuaaucaacguaaugaaagagcucaacuuccccaaguauaaagcuuuagggcuaacagaaauagaagaaagauaugacaucggucaagaaaaaacaaaacguguagaagucaucaccgauuggacaaaaagaaaugaucacagacaucacgcaaugaacgcacuaaccguugcauuuacgaccaguagccacauucaauacuuaaacuaccuuaacgcccgcaaaaacgaaagccacaaagaacacaagaauauaaaaggaaucgaaaauaaaauaacucauaaacaaaaagacaaaaggaaauucauaccaccgaugccgaauuucagagaagaagcuaaaaaacauaucgaaacuauauuagugucaauaaagaacaaaaacaaggucuacacaaaaaauauaaauaaaacuaaaaaaaaaucaggucacaauaccaaagaacaauuaacaccacgaggacaacuccacaaagaaacaguauacggaaaaucaaaaagaccaaugucaaagccuacaaaaauaaacaaaaauuucucucuagaacaagcucagcucauaauuaacguacaagaaaaggaauuaguauuaagacaccucgcucaauuugauaacaacccagccguugcauuugauacaaaaacacuaaaaaagaugccauuacugaaaaacggugaaccacuaaaggaaguacucugcuuugaagaaauuuucacaauaaggaaagauauaacaccugauuuaaagauagagaaaguaguggacgaaaaaauaaaggcuaucuuagaacagcgcaaaaaagacuucggaggaaaugcaaaagaagcuuuuucagaccuggacaaaaacccaauauggcuaaacaaaaaaaaagggauuugcauaaaaaggguaacgauaaccggagucuccaaugcagaagcacuacaccaccaaaaagaucaccuuggcagggaaauucuagacgacaacgguaauccaauaccagcagauuucguaucaacugguaacaaucaucaccuggcagucuaucucgacucugaggguaaacuccaagauaauauagucucauucuaugaagcagugguccguacuucgcaagguuuaccagucguagauaaaggacuuaacaaagaccugggcuggaaauuccuuuucucguuaaaacaaaaugagauguucgucuuuccuaaugaugauuucgacaucaaugauuucgauuuauuagaugacaaaaaagcagaguuaaucucaaaacauuuguaucgcguccaaaaaauaucaaaaguaucagcuggaaacucauuuguccgggacauagucuuuagacaccaucuagaaacaacagucaaagaaguaaaggaauuaaaagauauauccuauauacaacuuaaaagccuagaaggacuaagaaauauaaaaaaaguaagaaucaaucacauaggcaaaaucguccaagugggagaauacuga

SEQ ID NO: 9104 - RNA, 4221 nt, Artificial Sequence
  Cas9 variant
auggaaaagaaaauaauaggcauugacuuagggguaaccucuauaggaugggcauacguaauagaagacgaaaacggacacucaagaauauuacguaucgguacuagagucaacccacuaacaacagaagaacucaaaaacuucgaacaagggaaaccgauaacagaaacugcagaaagaacacucaaaagaucaaugaggagaaaccuacaaagauauaaacaacgaagaacuaaccucauaaacguccuucucaaaaacaaacuaauaacagaaacuacagcacuagcagaagacggaaaagggacaacacaucuaacucaugcauuaagagcaaaagcagcauacgcgcagauuccauuagaagacuuugcaagaguccuguuaaugcuuaacaagaaaagggguuauagaucuuccagaaaaguaaaaacagaagcggauggucaagcaauagacggcauggcaguugcaaagaaauuguaugaagaaaacauuacaccgggacaacucugcuacacauuacuguuacaaggaaagaaaacgcuaccagacuuuuaucggucagacuuacaaguagaaauggaaaaaguauggacuuuucaaaaacaauuccaucaagcaauccuaacggaugaauuuagaaaauauauugcaggcaaaggacaacgagccacagcugccucguuuuggggaaaauaugguuucaauacagccgaauuuaaaggaucaagagaagagaagaaacucaaaucauaugaauggcgcagucaagcuauaacuacaccccuaucacaagaagaaguggcagcugugaucacagacaucaauucgaauauugcaaauucaagcggauaucuuggagcaauaucagauagaucaaaagaauuguucuucaauaaacaaacagucggacaauaccaauauaaucucuuacaacaaaauccacauaccaaccuaagugggcaaguguucuauaggcaagacuacuuagacgaguucgaaacaauaugggaaacacaagcaacauuccacacaaugcuaacaccaucucucaaagaagaaauacgugacauaguaauauucuaucaacgaaaacuaaaaucacagaaaaagcuagucagcauaugugaguucgagaaaagaaucuuggaaccacuacagggugauaaaguaguagguuauaaaguagcaccgaaaagcaguccauuauuccaagaauuuaaaauauggcaagcccuaggaagaauggaaauucaacauaaaguuacaaaagaacgacacuuccuggaccuagacgcuaaacagcuacuauucgacgaacuaaacguaaaaggagaccucacaaaagaaaacgcacuaacaauacucgguuuuaaaccaaaagaaugggaaugcaaccuauuaaaauuagaaggaaaucgaaccaaucaggcccucuaugaagcauaucuuaaaauacuugaacuugaagguuacgaagugaaagaccuauuaggccuaaaacuagauaaagaugauauaaaacuaucagaacucccaguugaugcagcagauaucaagaaaaugguaagagaaauuuucgagacucuuaacauaaaaaccucuuuauuggauuuuaacgcgacauuaccgggcaaauccuucgaacaacaacacgcauaccagcuauggcauuuguuauauucauaugaaggagauaacagcccauccggcaauaagaaacuucaagaccuacuccaggcaaaauuuggauuuacaaacgcacacggacaaauccuugcaaaugucagccuagaaacagacuacggaucucugucagcuaaagcaauacgaaaaauuuucacacauauuaaagaaaaucacuacucggcagcaugcgcguuggcaggcuacaaucauucaucauaucuaagcaaagaagaaaaugaacaaaggauacuaaaagaucgucuaacaauauuacccaaaaacagccucagaaauccagucguugagaaaauccucaaucaacuaauuaaucuacuaaauacuauauucgacgacccauaucuaggaaaaccagacgaaauaagaauagaacuggcucgcgaacucaagaaaaauguucaggaaagacaaagauuaaauacugagauaaccaaaaauaacacagaacacgaacguauaacuaaaauucuaaucaaagaagauaauaucaaaaacccaacaagaaaugauauaauaagauacaaacuauaucaggagcucaaacacaaugguuauaaaacgcuauacuccaacaccuacauaccuagagaagaauuauucgguaaaaacuuugacauagaacauauaauaccacagucuauacucuuugacgauagcuucuccaacaaaacacuauguguaagaaaagaaaacauagacaaagcagauagaaccgcaauggauuucauaggaccauacuucggagaggauaaaguccaagaguacauaaacagaguagaaaugcuucaccaaauuaaccuuaaaaacccugaagaagggauaggaaaaggaaaauauaagaaacuacuaaugaaagccagcgaaauaggacaaggauucauagaaagggaucuaagagauacacaauacauagccaagaaagcccgacaaaugcuacuugaaguaacacgaacaguaguagcuacaacaggaucaaucacaaaaagauuaagagaagauuggggccuaguuaacguuaugcaagaacucaacauggauaaauauagacagcaaggacucacagaacugauagagaagaaagaugguucgaccaaagaaaggauuacagacuggaccaaacgaaacgaucacagacaucaugcuauggaugcacuaacaauugcguucacaaaacauagucacauccaauaccuaaauaaucucaaugcaagaaaaucagacgacaagaaaggcaaagagauuuucggaauagaacaaaaagaaacagaaaaggugaaagaugacaccggucagacgcaaagaagauuuaaguuaccaaugccugauuuccgucaagcggccaaacaucacuuagaacacuuacucauuucauucaaagccaaaaacaaaguauucacaaagaauaaaaacaaauauaagaccaaaaauggagaacaagugaaacucgaacucacaccgagaggucaacuacauaaagagacaauauacggcaggaucaagaaauaugucacgcaugaggaaaaagucagcucaaaauucaacgcccaauuaauacaaacuguagccaacaguaaauacagauacgccuuauuaaaacgcuuagaagaaaacggaaacgaucccaaaaaggcguucacagguaagaacucuuuagauaaaacuccccuauucguagacgcuacucaacaagagaaaaucccaccaguaguaaagcuaguuucaauugaacaaggauauacuaucaggaaagauauuacgccagaaaauuucaaagaugcaaaaucuauugagaaaauuguugauguuggcauacgaaaucuacuccaucacagauuagaaacuuauaaugguaacgaaaaagaggcuuucuacaaucuagacaagaaccccauauggguuaacgaaagcaaaggaauaugcaucaaaagaguaacuauuacaggagucacaaacgcagagccacuacauuauaaaagagaccaccaugggaaacccauucuugauaauaacggaaacagaaccccugcugacuucguuucaacaggcaauaaccaucaugcagccauuuaucgagacgcugcagggaauuuacaggauaacguaguaucauucuaugaagcuguagcacgagucaaccaaggauuaccaauaauugacaaaucauuaaauaaagaacuaggguggcaguucuuauucagccuaaaacaaaaugaauguuucgucuucccaaaugaaggguucgauccauuagaaauagaccucuauaauccagccaacaacaaauuaauagccgcaaacuuauucagaguccagaacuuuucaagacuccaauacggcaacaauauuauuagagacuacaauuuuagacauauauaugaaacgagcguggaaaaucgcaaagaacucaaagacauagcauauaaacaaguaaaaucacuaccaauauucgagaagaucauaaaaguaagaauaaaccauauaggacaaauuguaaaaacgggcgaauauuga

SEQ ID NO: 9105 - RNA, 4224 nt, Artificial Sequence
  Cas9 variant
augaucaggaauauuuuaggacuagaucucggaguaucaaguauuggaugggcauauguacaagaagauuccaaaaacucagaaaacaauagaauaauuaaacuuggaguucgcgugaacccuuugacuguagaugaacaacuaaacuuugaaaaagguaaaccaauuacaacaaacgcugggaggacauuagcacgaagugcaagaaggaacuuacaacgguuuaaacugcgacgaucaaaucuaauggauguacucaagaaaaauaacauacucaaagaaacagauuuacuugcagaaguaggcaaaaacucuacauuucagacacaagaauuacgcgccaaaagcgcaaaagagaaaauagaacuuucagaauuugcgaggguccuucuauuaauaaacaagaaaagaggauauaaaucaagcagaaaagccaaaaaugacgaagacggacaaauaguugacggaauggcaguagcuaagaaacucuucgaagaaaaucuaacaccaggagaauacagcuaccaacuacuucagcaaggaaagaaacaauuaccagauuucuaucgaucagaccuccaagcagaauuugacaaaaucugggacuuucaaaaacaauuuaaccccgaaauuuucacuaacgaauuauacgaaaaacuacaaggcaaaaauagaaacgccacguggaaagaacuugaauuuccauuuagccuaguuggaauuaaacaaacaggaacaaugcaagaaaagaaaguagagaaauacuucuggagaagcgaggcaguaaagaaacaauuagauuucgagagcuuagcagucguguuccaagaaauuaauuccaauuuaaauaacucuuccgguuacuuaggugccauaagugacagaagcaaagaacuauauuuuuacaaccaaacuguaggagaauaccuauuccaacaacucaaaaccaauccgcauaccaaauugaaaaaccaagucuucuaucgacaagauuaccuagaugaguucgagaaaauaugggaaacacaaucaaaauaucacaaagaauuaacaaaagaacuuaaagaagaaauaagagacauaacuauuuucuaccaaagaaaacucaaaucacagaaaggucuaaucucaauaugcgaguucgaaaacagagaaauagaaauaacggaaaacggaaaaacuaaaaagaaaacaguuggacuaaaaguagcuccaaaaaguucuccuuuauuucaagaauuuaaaauuuggcaaguccucaauaaccuucaauuucaaaacauagaaacaaaagaaguauucccaauagauuuagauuuuaaacaaaguauauucgaugaaguaaauauaaaaggcaaacuaucggcaaaagauguacuagaccucgugggcuauucuggaaaagaauggaaaaccaacuuuaaagaaaucgagggaaacuacaccaacgaaaauuuauacacagccuuuuuaaaaaucauagcaucaaaagaaauagaauuuccaaaagaguucaaaauaacaauagacgaugaaauaaaagucucgaaaauuaacgcaucggcagaaaucauuaaacuguucguccgagaaaaauuuagugaauuagguauagauacauccauacucgauuuuaacccggaacuugaagguucagauuucgaaaaacaagcaagcuaucagcucuggcaccuacuauauucuuacgaaggagaugacucuuccuccggcaacgaaaaauuauacgaacucuuagaaaacaaauucggauucaagaaagaaaauaguaaaauuuuagccgaaauaggauucucacaggauuauggaagucuaucgagcaaagcgaugcguaaaaucuauccauacauuaaagaacauaaauacucaguagccugcucguacgcgggauauaaucauagcaaaaauucucuuacaaaagaacaacucgaaaaccgcauauuaaaagaaagacuugacauacuccccaaaaacucguuaagaaauccugucgucgagaaaauacuaaaccaaaugauuaacuuaguaaauugccucaucgaugaauacagcgaaaaagacaaagacggucaaaucgucaaauacuuuaaauucgaugaaauaagaauagaauuggccagagaacucaaauuaaaugcggaagaaagagcuaccaugaccucggaaauuaauaaagccacgauacaacaucaaaaauaugcugaaguuuuacaaagagaguucggacuaaaagcaccaaguagaaaugauaucauucgcuauaaacuauaccuugaacuugcaaacaacggauucaaagaucuuuacacagaugcaaaaauugaacgugaaaaucuauuuacagacaaauacgacauugaccacauaauaccccaauccagauuuuucgacgauagcuuuagcaauaaaguauuaguaccacgcaacgcuaaccuaaagaaaggaaauuucacagcguucgacuaucucgaaauagaaggaaaggaaaaacuugaaaaauuccucaacauaauaaaagaccuauaugacaagggugcaauuacuaaagcaaaauaugaaaaacuacaaaagaaggauuucgaaauaggcgauggauucaucgaaagagaucuaagaaauacgcaauacauagccaagaaaagcaaagaaauauuauuuggaaucacgaacucugugguaacaacauccggacgaauaacggauaaacucagagaagacuggaaccucauuaacacaaugaaagagcuuaacuuagagaaauaucgaaaacuagguuuaacagaaacaguaauuaacucuaaaggcgaagaaaaacaaaggauaauagauuggaccaaaagaaacgaccauagacaccacgccauggaugcauuaacuguagcauucacaacacacaaucacauacaguaccucaacuacuuaaaugcccguaaagacgaaaaacauaaagagcaucagaacauauuugcuauagaaaaccucauaacugagauuauugacaaaaagaauggauccaaggagcgaagauucaaagaaccagucaaaaauuuaagggcagaggcuagaaaacaccuagacgaaauucuaauaucacacaaaguaaagaacaaaguagucaccaaaaauauaaauaaaaucaagaagaaaggaucaguaauagcuaaaaccgaacucacuccaaggggucagcuccauaaagaaacuauuuacggaucaucuaaauuccucaaaacuaaagaagagaaaauaucaggaaaauucgacguagaaacaauccaaaaaguucaaaacgaaagauaccgaaacgcccuacuuaaacgacugcaagaauuugguggugacuccaagaaagcauucacagguaaaaacgugauauccaaaaauccaauauucuuaaacaacgagaaaacagaacaacuaccagaaacagucacucuggcaugguacgaaaugggcuauacaauaagaaaagcgguaaaccccgacaauuuuaaagauuuuaaaaauaucgagaaaacaauugauaaaggaauaagagacauacucacaaaaagacuuaaagaguucaacggcaacucuaaagaagccuucuccgauuuggauaaaaauccaauuuggcuaaacaaauccaaaggaauaagcauaaaagcaguaacaauaacaggaaucaauaaugcagaagcccuucauuacaagaaagaucaucuaggaaaagauuuucuagaugaaaauggcaaacgcauugcaguagauuuugucucaacaggaaacaaucaucauguagcgaucuaugaagacgaaaacggaaaccugcaagaaaaagucgugucuuuuuacgaagcaguagaacgaguaaaccaaaauuuaccaauaaucgacaaagaauauaauuccgaaagcggauggaaauuccuauucacgaugaaacaaaacgaaauguuccuauucccuagugaagacuuuaacccuaaagaaauggaccucuucgaugagaaaaauguaaauuuaauaaguaaaaacuuauucagaguacaaaaauuuacaaucaaagacuacuucuuccgacaucacuuagaaacuaacguagaagauucuucaccacucaaaggaauuacauggaaacgugagggcuuaaauggaauagagaacauccugaaagucagacuaaaccaucuaggaaaaauaguucaaauaggugaauauuga

SEQ ID NO: 9106 - RNA, 4227 nt, Artificial Sequence
  Cas9 variant
augacaaaaaacauauuaggccuugauguaggaguuucgucuaucggaugggcuuuaauaaaugaagacauagaaaauccgaaaaauaacaaaauaaucaaacuaggcgugagaguuaacccccuaacaguugacgaacagauaaauuuugaaaaaggaaaaccaauuacgaccaacgcgggaagaacacuugcgagaggggcuagacgcaacuuacaacgauuuaaacuaagaagauuccaucucauugacauacugcaaaaaaauaauauacuuaaacaagccgaccuauuagcugaagucggaaaaaauucaaccuuccaaacucaagaaauaagagcaaaaagugcuaaacaaaaaguugaacuauccgaauuggcuagaauauuucucuugaucaacaaaaaacguggcuacaaaucuagcagaaaggcaaaaaaugaagacgagggucaaauaauagacggaauguucauagcaaaaaaacuauacgacgagaagcuaaccccaggagaauauucauaucaacuauuaaaagaauccaaaaaacaacugccagauuucuauagauccgauuuacaaucagaauucgauaaaaucuggaauuuccagaaacaauuuuaccccgaaaauuucucagacaaucuauauaaagaauuacaaggaaaaaauaaaaaugcaacuuggaaaacacuggaaauccccuuuagucuagugggcauuaaacagaccggaacccuacaggaaaagaaguuagaaaaauacagcuggcgaucugacgcagucaaaaaacaacuagauuaugaaaaacucgcagucguuuuccaggaaaucaacucaaauaucuacaauucuucaggcuauuuaggagcaauaucagauagaucuaaggaacuauacuuuaauaaucaaacagucggugaauaucuauacaaccaaauuaaagaaaacccucacaccaagcuaaaaaaucagguauucuaucgacaagacuaccuugacgaauucgaaaagauuugggaaacgcaauccaaauaucacacaacauugacuaaagaacuaaaagaagagauacgagauauaauaauauucuaccaaagaaaacucaaaucacaaaagggauuaauaaguauaugcgaguuugagaauagagaaauugaaauaaaagagaauggaaaaauaaaaaaaaaaacaguaggccuaaaaguagcaccaaaaucaucgccccuauuucaagaauuuaagauuuggcaaauacuaaacaaccuccaauuccaaaauauagaaucaaaagagaucuucccaauagaucuagauuucaaagaaagcauauuuaacgagguaaauauaaaaggaagaauaucagcuaaagcagucuuagaucuacugggcuacagcggaaaagaauggaauccaaauuucaaagacaucgaaggaaacaacacuaacgaaaaccuauauaacgcuuacuuaaagauaauagcggaugaagaauucgaauuacccaaagaauuuaaacuaaacggugaugaugaucucuacguuuccaagauagcaugcucugcuaguaaaauaaaagacuuuguaaaagaaaaauuuucugaaauagguauaaauacaucuauauuggacuuuaacccagaacuagaaggcaaagauuuugaaaaacaagccucguaccaauucuggcaucuacuauacucuuacgaaggcgaugauagucaaucaggaaacgaaaaacuauacgaacuucuugaaaaaaaauucggauucaaaaaagaacauagcaagauacuauccaacauaggauucccacuggacuaugguaaccuaagcacaaaagcaaugagaaaaauaauaccgcacuuaaaagcgggcuuaagcuuugccaaaaaauccaaagaagauaacauacuaucagcaaccgcgauggcuggauacaaccacucgaauagcuacacaaaagaggacuuagcuaaacgcguacuaaaggaaaaacucgaagucuucccaaaaaacucccugcguaauccaguuguagaaaaaauucuaaaccaaaugaucaaccuaguaaaugaagcaguagaggaauacgggaccauagacgaaguaaggauagaacuagcacgagaauuaaagaaaaacgcagaagaaagagcaaauaugacaucagaaaucgggaaggcaacgcuacuccaccaaaaauacgcugaaauacuaaaaaaagaauucgauaucccaguaccaagcagaaaugacaucauaagauauaaauuauaucuggaacuagcaaacaacggauacaaggaucuauacacagacguucaaauaaaacgagaagaacucuuuaccaauaaauaugacauagaccacaucauaccgcaaagcagauucuuugaugacuccuucaguaauaaaguauuggugccuagaggagcaaaccucaaaaaagcuaaccaaacagcauucgauuaccuagagaaugaagacaagcaaaaacuggaaaaauuccucaacauaauuaaaaaccucuacgacaagggugaaauaaccaaagcaaaauacgaaaaacuucaaaaaaaaggaagugauauaggggaagguuuuaucgaaagagauuuaagagacacccaauauaucgcaaaaaaagcaaaggagauccuuuucggcauaacucauagcguaauaaguacauccggaaaaauaacagacaaacuaagagaagacuggaauuuaguaaacacaaugaaggaacuaaaucuugacaaauauaaaaaacuaggccuaacagaaaccuuauugaauuccaaaggcgaagaaaaagaaagaaucauagauuggaguaaaagaaaugaucaccgacaccaugcaauggacgcuuuaaccguggcauuuaccacccacaaccacauacaauaccucaauuaccuaaacgcccgaaaagacgaagaucauaaacaacacaaaguaaucucuaacauugaaaacuuaauaacaaaaguuuucgagaaaaaaaauggugcaaaacaaagacgcuucaucgaacccauaaauaacuucagagucgaugcuaagaaacaucuagaugaaauacucauaucucacaaagccaaaaacaaggucguaaccaaaaauaucaauaaaauaaaaaaaaaaggaucugucgucgcaaaaacagaacuaacacccagaggacaacuacacaaagagacgaucuauggcuccaguaaauuucucaaaacaaaagaugagaaaaucucaggaaaauuugaccuagaaacaauaaacaaaguacagaacgaaaaguacaaaaaugcacuacuucaaagauuaagagaguucggugaagauucaaaaaaagcuuuuacaggaaaaaacguuauaagcaaaaaccccauauauuuagaugaggaaaaaacccuacaaaucccugaaucaguaacccuggcuugguacgaaaugaucuacacgauacgcaagccagucaauccugauaauuuuaaagauuacaaaaauauagauaaaguaacagacgaaaaaauacgugcaguacucaccgacagauuacgaaaauucaauggaaacagcaaagaagcuuuuagcgauuuagaaaaaaauccaauauggcuaaauaaaucaaaaggcauagcaaucaaaacugucaccauaaccggaaugucaaauguugaagcauuacacuauaaaaaagaccaccugggaaaagagauucuugauaagaaaggcgauagaaugccaguagacuucgucucaacaggaaauaaccaccacgcugccaucuaugaagacgccaaaggaaauuugcaagagagaguugugucauuuuaugaggcaguagaacgagucaaccaaggacuaucagucguaaauaaagacuacaacgcagguuuaggguggaaauuucuauuuacuaugaaacaaaacgaaauguuccuauuccccagcgaggacuuuaacccaaaagaaauagauuuauacgacgaaaagaauuuaaaauuaauagcaaaaaauuuauucagaguacaaaaauucggggaacucagcaaaucgggauucugguuccggcaccaucuagaaacaucagucgaugugaaaaaagaauugagaaacuauucuuacuuggauuucuacucaaaagacuucaugaaaaccauuguuaaaguaagacuaaaucaucuugguaaaaucguccaggucggcgaauauuga

SEQ ID NO: 9107 - RNA, 4230 nt, Artificial Sequence
  Cas9 variant
augucaauaauuaacuuccaaagacgaggucuaauggaaacacaggcuucaaaccaacuaauaagcucccaccuuaaaggauauccgauaaaagacuacuucguuggccuagacauagguaccuccagcgucggcugggcuguaacgaacaaggcuuaugaacuccucaaauucagaagucauaaaauguggggaagucgauuguucgaugagggagaaucagcaguagcacgacgaggauuucguucaaugagaagaagacuagaaagaagaaaacuacgccucaaauuacuugaagaacuauucgcugacgcuauggcgcaaguagauccgacuuucuuuaugagacuacgugaauccaaauaccacuacgaggacaaaacaacaggucauuccucaaaacauauauuauuuauagacaaaaacuauacagaccaagacuacuauaaagcauacccaaccauauaccaccuaagagcagaacucaugaaagauggaacagaugauauuagaaaacuauuccuugcuguucaucacauacuaaaauacagaggcaacuuccuauacgaaggagcuacauucgacuccaacgcaaguacauuagacgacgugauaaaacaagccuuagagaacaucacauuuaacugcuucgauugcaacucagccaucucaagcaucggacaaauacucauggaagcggguaaaacuaaaagugauaaagcaaaagcaaucgaacacuuaguagacacuuacauagcuacggauacuguagacacuuccucaaaaacacaaaaagaucaagucaaagaagauaagaaacggcuaaaagccuucgcaaauuugguauuagggcuaaacgcuucacuaauagauuuauuuggcaguguagaagaauuggaagaagaccugaagaaauuacaaauaacaggagauacauacgaugauaaacgcgacgaguuagccaaagcauggagugacgaaauauauauaauagaugacuguaaaucaguauacgacgcaaucauauuauugucaaucaaagaaccaggacuaacuauaucagaaucaaaaguuaaagccuuuaacaaacauaaagacgaccuggccauauuaaaaagccuguuaaaaucagaucgaucuaucuacaauacaauguuuaaaguagacgagaagggauuacauaacuacguacauuacauaaaacaaggaagaaccgaagaaacaagcugcaaucgugaagacuucuacaaauauacaaagaaagucgucgaagggcuaccggacucaaaagacaaagaauacauacuguccgaaauagaauuacaaacacuuuuaccauuacaaagaauaaaagacaacggaguaaucccauaccaacuacaccuugaagaauuaaaagucauauuagcaaaaugugggcccaaauuucccuucuuaaacgaaguugccgacggcuucucagucgccgaaaaauuaauaaaaaugcuggaauuuaggauaccauacuauguggguccauuaaauacgcaccauaauguagauaacgggggcuucgcgugggcuguuaggaaagccagcggcagaguuacaccuuggaauuucgaugacaaaauugacagggaaaagagugcagccgcauucaucaaaaaucuuaccaauaaaugcacauauuuguuaggugaagacguacuaccgaagucgagucuucuauacucggaguucaugcuacucaaugaacuaaauaauguacguauagacggaaaaccacucgagaaagcagucaaagaacacuuaauagaagcgguguuuaaacaagaccacaagaaaaugacuaaaaacagaauagaacaauuuuuaaaagauaacaacuacauaccugaaaaacacaaaccugaaauaacaggccuagacggagaaaucaaaaaugaucucgcaucauauagagauaugguucgaauacuagguaauaauuucgaucuuaguauggcagaagaaauuaucacagacauaacaaucuucggagagucaaagaaaaugcuuagagaaacccuaagaaacaaauucucaucaagauuagacgaugaggccaucaagaaauuaucuaaacuacgauauagagauuggggucgcuuguccagaaaauuacuaaacguaauagaaggcugugacaaagcaggagaugguacccccgaaacuauaauaauacuaaugcgaaauuuuagcuacaauuuaauggaacuccuuggagacaaauuuaguuuuauggagagaauacaagaaauaaacgccaaauuaauagaaggucaaauaguuaauccacaugacaucauugacgauuuagcauuaucuccagccguaaaacgagcaguuuggcaggcuuuaagaauaguagacgaaauuguacacauaaagaaaacacuaccagccagaauauuugucgaaguuacaagaagcaauaaagcggaaaagaaaaagaaagacagcagacaaaaacgccuaagugaucuuuaugcagcaauaaagaaagaugaugcacuacuaaguggguuaacaaacgaagaguuuggagggcuaaaaucagggcuugcaaaauaugaugacgccgcauuacguucaaagaaacuauaccuauauuacacgcaaaugggcagaugugcuuacacgggagaagucauagaccuaagucaacuaaauacagauaauuacgauauugaccacauauacccaagaucuuuaaccaaagacgacuccuucgauaaccuuguauugugcaaaagaacagcuaacgcccaaaaaucagacacauauccaauuaguaaagaaauccaaaaagcccaaaaagcauucuggauauuucuuaaacaacaaggacuaauaucagaacguaaauacgaaaggcuaacacgaauaacaccacuaacugcugacgaucuuaguggauuuauugccagacaacuggucgaaaccaaucaaagugucaaagcagcaacaacccuacuaagaagauuauacccaggaguagauguaguauuuguaaaagcagaaaacgucacagauuuuagacacgauaaugauuuuauaaaaguaagaucauuaaaucaccaucaucacgccaaagacgcauacuuaaauauagugguagguaacguuuaccacgagcgauuuacccgaaacuuuagagcauucuuuaagaaaaauggagcuaaucgaacauauaacuuagcaaaaauguuuaauuacgacguaaauugcacaaaugcgaaagacgggaaagcaugggacgucaaaacaucaauggacacagucaagaaaaugauggccucaaaugacguccguguuacuaaacgacuccuagagcaaagcggcgcucucgccgaugcaacaguauauaaagccgccguagccgaaaaagcuaaagauggcgcauauauagguaugaaaacaaaaucauccguguucgcggauguuagcaaauaugguggaaugacaaaaaucaaaaacgccuacagcauaaucguucaauacgcuggaaagaaaggcgaaguagucaaagaaauugugccccuaccaauuuacuugaccaauagaaauacuacagaucaagaucuuauagacuauguagccagcauaauaccacaagcuaaagacauuucaauaaucuacagaaaacuaugcauaaaccaauuagugaaagugaaugguuuuuacuauuaucuaggugguaaaacaaacucaaaauuuugcauugacaacgcaauccaaguaaucguuucaaaugaauggauaccauaucucaaaguucuagagaaauuuaacaacaugcgaaaagauaacaaagaccucaaagcuaacguaauuuccacuagagcauuagauaacaaacacacaaucgaggucagaauaguagaagagaaaaacauagaguucuuugauuacuuaguuucaaaacuuaaaaugccaaucuaccagaaaaugaaaggcaauaaagcagcggaacuaagcgaaaaaggauauggacucuuuaagaaaaugucauuagaagaacaaucaauacaucuaauagaauuacuuaaucuacuaacuaaucagaaaacaacuuuugaaguuaaaccacucggaauaaccgcaagcaggagcacaguaggcucgaaaauaaguaaccaagaugaauuuaaaguaauuaaugaaucaaucacaggauuauacaguaacgaaguaaccaucguguga

SEQ ID NO: 9108 - RNA, 4233 nt, Artificial Sequence
  Cas9 variant
augaccaaaaacauacugggccuugaccuaggggucuccuccauagguugggcacuuguccaagaaaauaguaaaaacccugaaaauaacaaaaucgucaaacuagguguacgugugaauccucuaacaguagaugaacaaauuaacuuugaaaaaggaaaaccuauuacaacaaacgcaucaagaacacuagcucgcagugccagaagaaaucuacaaagauuuaaacuaaggagagcuaauuuaaucgauguuuuaaagaaagggaauauacucaaacagggagaucuacuaacagaaauaggcaaaaacucaacauuccaaacgcaagaacugagagcaaaaucagcaaaagaaaaaguagaacuaucggacuuuguaagaauauuauuacuaauaaacaagaaacgaggguacaaaagcagcaggaaagccaaaaacgaagacgaagggcaaaucauagauggaauggcgguugcuaagaaacuauaugaagaaaacaucacuccuggagaauacagcuauaaacucuuacaagaaggacgaaaacaacucccagauuuuuaccgaagcgaccuucaagccgaauuugauaaaauuuggaacuuucaaaaacaauuuaacccagaaauuuucacaaacgaacucuacaaaagauuacaaggcaaaaaccgaaacgcuacauggaaagaauuagagauacccuuuuaucucguaggaaucaaacaaaucgguaccaugcaagagaagaaaauagaaagguacuucuggaggucagaagcuguaaagaaacaacuugauuuugaaagucuagcagugguguuccaagaaauaaacucaaacuuaaacaacucuucaggauaucuaggggcaaucagcgaccgaucuaaagaacuauacuuuaauaaccaaacuguaggagaauaccuauacaaucaacucaaaauuaacccacauacaaaacugaaaaaucaaguauuuuacagacaagauuaccuagaugaauuugagaaaauaugggaaacacaagcaaaauaucauaagaaauuaaccaaagaauuaaaagaagaaauaagagacauaguaauauuuuaccaaagaaaauugaaaagucaaaaaggacugauaucauucugcgaguucgaaaauagggaaauagaaaucacgguaaaugguaaaaccaaaaagaaaacuguaggucuuaaaguaguuccacgaagcucuccacuuuuucaggaguucaaaaucuggcaaaggcucaaugaucucgaauuuaaaaacguagagacaaaagaaauuuuuccgcuagagcucgaacauaaagaaauauuauucggaaacuuaaauauaaaaggaaaucucagcagcaaagaauuaauagaacaauuaggauauccgaguaaggaauggaaauguaauuuuaaagaaauugacggcaacaaaacccacgaaaaucuauacacugccuuccuaaaaauaauagcuaaugaaggaauugaauuuccaaaagaguucaaauuaucaauagacgacgacauuaaaguaaguaaaauagaugucagcagcgagaaaauaaaagaguucauaaaagaaaauuucuuaaagcugggaauaaauacauccauuuuagacuucaauccagaacuugaugguaaagacuuugaaaagcaagaauccuaccagcucuggcaucuuuuauauaguuacgaaggagacgacuccgcaucaggaaaugaaaaguuauacgaacucuuagagaagaaauucggauuuaaaagagaauacucaaaaauuuuagcugacguaggauuuagccaagacuaugggucauuaaguagcaaagcaaugaggaaaauauuuacauacauaaaagaaaacaaauacagugaagcaugucacuuagccggauacaaucacagcaaaaauagccuuacuaaagaacagcuagcaaacagaauauuaaaagaacaacuagaaaucuuaccuaaaaaugcacuaagaaaccccguaguugaaaagauacuaaaucaaaugauaaacuuaguaaacgaagugauaaaagaauauggaaaacccgaugaaauaagaauagaauuagcgagagaauuaaagaaaaaugcugaagaaagagcgaacaugacaucagauauuaguaaagcaacacuacugcaucaaaaauaugcagagguacuacaaaaagaguucggaauaaaagcaccuucucguaacgacauuauaagguacaaauuauauuuagaauuagcaaacaacggauacaaagacuuauauacaaaucagaaaauagaaaaagaaaauauauucacggauaaauaugacaucgaccacauuauaccgcaaaguagauucuuugaugacucauuuucgaauaaagugcuaguaccaagaugcgccaaucaagauaaagacaacuacaccgcaguggauuauaucgaaaagaaguauggagagcgagguaaagaagacuuuuuaaacagaauacaccuaguauuuaaaucaaaagaggcuauagcaggcaagucagaaucccaaauaagcagcaugaauacaaaauuccugaaacuacaaaagaaaggauccgagauaggcgaaggauucauugaaagagaccuuagagauacacaauacauagcuaagaaagcaaaagaaauacuauuuggaauuacaaauucagucauaucaacaucagguagaaucacagauaaauuaagagaagacuggaauuugguaaacaccaugaaagagcuaaaccuugaaaaauaccggaaacuaggcuugacagaauuaauagcaaauucuaaaggagaagaaaaagagagaauaauagacuggaccaaaagaaacgaucauagacaccacgcgauggacgcucucacgguagcauucacgacccauaaccauauacaauaucucaacuacuuaaacgcaagaaaggaugaaaagcauaaagaacaucauaacauauuugccauugagaacaucauaacagaaauagucgaaaagaaaaauggcucaaaagaacgacgauuuaaauuaccaaucaaaaacuuccgaaccgaagcgaagaaacaauuggaagaaguacuaauuucacauaaagccaaaaacaaaguggucaccaaaaauaucaauaaaacaaagaagaaaggggguguaguaucaaaaauuguguuaacaccaagagggcagcuacauaaggaaacgauauaugguuccgcuaaauucuuaaaaacaaaagaagaaaagauaucaggaaaauucgaucucgaaaccauaaacaaaguacaaaaugaaaaauucaaaaacgcacuacuagacagacucaaagaauuuaauggagauuccaaaaaggcauucacugggaaaaauguaccagcuaaaaauccaauauaucucaaugaacagaaaacagaacaaguacccgaaaguguaguacucgcaugguaugaaaccggauacaccauucguaaagcaguaaacgcagacaacuucaaagauuacaaaaaucuagagaaaauuauagauaaaggagucaaggaaauccuuaaaaaccgucucaaugcuuuuaacgggaaugcuaaagaagcauuuagcgacuuagaaaagaaaccaaucugguuaaaccaaucaaaggguauagcaguaaaaaccguaacaauuacggggaucaacaaugccgaaacacuacacuacaagaaagaucacuuuggaaacgaacuacuagaugaaaacggaaagaaaauuccgguugauuucgucaguacaggaaacaaccaucacguugcaaucuaugaagaugcugaugguaaccuccaagagagaguaguaucauucuaugaagcaguagaaagagucaaccaaggauuaaguauaauagauaaagaauauaaccaagacuuaggcuggaaauuucuauuuacuaugaaacaaaaugaaauguuucuauucccuucagaggacuuuaacccuaaagaaacagaccucuucgacgagaaaaacuuaaaccuaauuagcaaaaacauguucagaguccaaaaauucggaucacuucuuagugguuucugguuuagacaccaccuagagaccacagucgaucucaacucaagucucaaagauaccaguuacaaaguaauucaaagcuguaacaacuuaaaacuaauaguaaaaguccgacuaaaucaccucggaaaaaucguccagauaggagaguauuga

SEQ ID NO: 9109 - RNA, 4236 nt, Artificial Sequence
  Cas9 variant
augguaaagaaagaauauuucauaggauuagauauggguacgaguagcgucggaugggcagucgcagauacaaauuauaaucuacuaagagccaaaggaaaagauauguggggaguuagacucuuuccagaagcaaguaccgcugcggauagacggucgcaccgaacagcgagaagaaacaacaaaagaaaagcagcucgggaaggauucuuaagagaaauuuucgaagaugaaauaaacaaaauagauccuggcuucuucgaaagacuaaaagaaaguaaauacuacuuggaagauaaauuaacagauacaccauuuguccuuuucgcagacaaaggcuacacagacaaagaauacuacgaugaauacccaacgguauuccaucugauuaaagaacuaauuuccgaaaaaggcuuagaaccacaugauauaagacuggucuaccuggcuugucuaaacauuuauaaacacagaggccacuucuugaaugauacauuaucaggcgacgggauagauaauauaaacuccuuauguaaugauuuuaccuccuauuuagccgacuauaaucaaaacucagaagaugauggaacugagaaaauggacuuggauagcacagugcuugcaggaguuuuugaagaaacauuauguaacaaacaucuuagcaacagugccaagaaacgagacuuaauagacaaacuaggaauuacaaacaaaacgaaauauuuaacagaaaugauggcucucaucaguggauuggcaucaagcgugucgaacauguuugcuaaagacaccuaugacgaagaacagaagaaauuuaaacuaucauucagaucaagcaauuuagacgaagauaugguaaaaguacaggcaaugcuaacuccagaagaauacgaaaugaucuguauuaugaagaaaauacacgauuggucaguaguaucagucauaauggggagccacaaauacauaagcgaugcacguguagaacucuaugaaaaacauaaacaagaucuagcuaaacuaaaagcuauauacaaagaauaccuaccagacaaauaugacgcaauguuucgagaaaugacagacaacucuuauagugcauacguagguaaaguaaguucaaacaagaaaagucaaacugguaaccauaaaguaagaaugcaaagaagaggugcaaaaugcaaacaagaagacuuuuaugaucgaaucaagaaagaaauaaauaguguuccacaagaagagaaaauugacauacuacaagacauggaaacuaacuccuuucuaccuaaacaauuaacaaaugaaaacggaguaauaccuuaucaacuccauuuagccgaacugaagaaaauucucgauaacgcuuccacauaucuacccuuuuuaaacucagcagaugaaacagguauaaguaauaaagacaaaauuauacaauuguucgaauuuagaaucccauauuacguaggccccuuauucaaaucagagaaaaauaaaacuaaugccuggguuguacgaaaagaaagugggaaaguguacccguggaacuucaacgagaaaauagacgaaaaacaaagcgcagaaauauuuauagaaagaaugguuagacauugcaccuacuuaaauaacgaaagugcauuacccaaaaacagcuuaaaauaugaacgauuuaggguacucaaugaacuaaauaaucugagaauaaacggggaacguauaucaccugaacuuaaacaacgaaucuacaacgaauuauucaaagugaaaaagaaacgaauaaccaaaucuaugcuuugugaauauuuauacaaaaacggaaucgcagacaaagacucagaacuuaguggauucgacggcacauucgcaaaugcacuacuaaguuaugguaaauuuagagaauuauucaacguagauaccuugaccgacaaacaagaagccgcagccgaagacauaauaaaauggucgacaguauauggcgauaguaagaaauuccuacaagagaaaauagaagagaacuacggaccagaaagcgaaaacccucucuuagacaacaaacaaaucaaaagaguaaugggauauaaauuuacagacuggggaaaccugucgcgagaauuucuaaacuuagaaggagcggauaaagacaaugauacuacaacaggcgaagucaugccauuaauaacgcgaaugugggaagaaaacuauaaccuaauggaacuaaugucuaacaaauucagcuaccgagacgcucucgcagagaaaacagaagaaauagagaaaacccuaacugacauagaauacgaagacuuggaagaccuauauauaucggcacccguaaaaaggaugacauggcaaacccuacuuauacuaaaagaaauauaccaaauaaugggauaugcaccaaagaaaauauucgucgagauggccagggaggaagaggagaaaguaaauggcaaaggagcccguaaaagcucaaggaagaaaagacuagaagauuuauacagaaacugcaaagaugccucaaaagaacucucgacaggaaucaaaaacgcagacgaagcaauacuccgaagaaagaaauuauaccuauauuauuuacaaaaaggaaaaugcauguacagcgguaaaacaauagacuuuaaaagccucuucacgaauaacuacgacauagaccauauauacccgcaaucaguaguaaaagacgauuccuuagaaaauaacaugguucuuguggaacgcaacuacaauaauaagaaaagcgacacuuuuccaauauucagcgauuggcaaaauaaaaugaaaccauucuggacaaugcuaaaagaacaaggauuuauaaaugaggaaaaauacaaaagacuuacaaggacagacgaauuaacugaugaugaauuagcaaacuucguaaaucgucaacucgucgagacaaggcaagccacuaaagucauagcggaacuccucaaaaauagcuuugaugauauagacucaaaaauaguauacgcuaaagccgggaauguaagcgaguucagacauaaauuuucaaugaaauacgauaaagaaacagaaaaaucaaguguuauccacccagaacugguuaaauguagaauaauaaaugacuuccaccacgcaaaugauucguauuuaaacaucguaguaggaaacauuuaugauguaaaauuuacacaaaacccauacaauuacauuaaagaauauaagaaacagaaaaauaauagcgcucuaagugagcaagaaaaggagaaauaccacauggacaaaaucuucaauuuugauguaaaaagaaacggugaaguggcauggauauccagaggggauaauaaaacccuagaaacgguauuaaaagugaugagaaagaacacccccauagugacacgaaugaacuuugaagaacacggacaguuagccgauuuaacaauuuauucagcguccgaugcacuaucuaagaaaggaguaggauauauaaaaguaaaagcaucggacgcuagacuggauguucuaaaauauggaggauacaaaaaguauaaaggagcauacuucuuuuuaguugagcauaccgaaaagaacaagcgaguacgaacaauagaaaauaugcccuuauaucugaaaaacgaacuuaacacuaaagagaaaaucgaauuauggugcgcugauaaagaaaauggacuaggccuuguagacccggacgucagacuaggaaaaauaaaacucuacucaaaaauucgaauugaugguuucgacuuauaucuuacgggaagaaccggaaauaauuuacucacgucaaacgcuguccaacucaaaauagggucaaauaaaccgagugauaacgacaaacuauuuuggagauauuacauaaauaaauugagcaaguacacagaaaacuccgaauuugucaguauucaaaauaacauuaaauuauaugaucuauuuguagaaauaaauaaugcuggaguauauaguaaaagacaaaauccaauuggggacaaacuccuagaaggaagaaguaaauucauaaaccuaacccucuccaagcaaguagaaacacuccucggaauaauacgaauauauucacuagaaaaucaaggagcagauuuaucaaacauuggaggacaagagaaaaacgguacaaugaaaccucauaaaagaaucagcgacaagaaagaaguucuacucauaaaucaaucaguuaccggacuauaugaaucaaaaauagaccuacuaaaaaucuga

SEQ ID NO: 9110 - RNA, 4236 nt, Artificial Sequence
  Cas9 variant
augaaaaauaucuuaggcuuagaccucggaacaaacucuauaggaugggcauuaaucaaacaaaaugcagaagaaagacaaggaaguauucuagguauggguacaagaguucuaccaaugagccaagacgucuuaggagacuuuggaaagggaaacaguguaucacaaacggccgcacgaacggguuaucgugguauucgaagacucagagaacgcuucuuacuacgaagagaaagauugcaucgaguauuaaauaucuuaggauuccucccauauuacuacgcagcccaaauagauuuugauaaacgauuuggcaaguuuaaggcagaaacggaaccaaaauugccauacaacaacgaaggauuuaucuuuaaaaauucuuuugaagaaaugcuaucagauuucaaaauaucccagccagaacuacuaucgggaaauaagaaagucccauaugacuggacgaucuacuaccuucguaagaaagcugugagucagaaaauagagaaagaagaacuggcuuggauacuuuuaaauuucaaccagaaaagaggcuacuaucaauuaagaggagaagacuucgacgaagaaaaagacaaaacauucguaacauuaaaugucgacaaaguaauugacagcggggaaaaaguaaaaggcaauauucuauuugauauauacuuuacaaacggauggaaguacgagaagcaaacaacaaaaccagaagauuggcuaggcagaucaaaagaauuuauaauuacagaaucacuauugaaaaacggagaaguaagaagaacguuuaaagccguggacucagaaaaggauuggaucgcuauuaaagccaaaacagaacaagaaaucgagacggcucauaaaacuguuggaaguuauauauacgaugcaauccuacaaaacccuaaacagaaaaucaaaggaaagcuaguacgaacaaucgaaagaaaauucuacaaagaagaacuacguaaaaucuuagaaaaacaaaaagauuuucauuuagaauuacaaaacgaggaccuauacagcgauuguguaagagaauuauauagaaacaaugacacccaucaauugagcuuagcaaagaaaucuuuuauccaccuauuucuugaagacauaauauuuuaucaaagaccucuaaaaagccagaaaaguaguguuucaaacuguacccuugagugcagaaaauacagagauaaaaacggagcggaggggauucaauuuuuaaaagucauaccaaaaucaaacccauacuaucaagaauuucguauauggcaauggaugaguaaccuuaaaauauaucgacgagacgaugauguaaauauaacaagugaaugucucaaaacggccgaagauuaugaagaucucuucguauuuuuaaauauaagaaaagaaguagaucaaaaagcaugucuacgacacuuuaaacuaucugagaaaacucacagauggaacuaugucgaagauaaaaaguauccauguaaugaaacaggaacaaugauaagugaaagacuuaagaaaguaggagacagcccugauaacaucuuuacgagggaaauggaacaacaaaucuggcauauaauauauagcguaaaugacaaaacagaauaugaaaaagcauuaaaaucauucgccaagaaaaaugaacuagacaacgacagcuucuucgaagccuuuaggaaauucccgccauucgauagugaauauggaaguuuuucugaaaaagcaauuaagaaauuauuacccuuaaugcgaauaggaaaacauuggaauugggaagcgguagacgagaaaauuaaaaaucggauucagaaaauuauaaucggagaauacgacgaaaacaucaaagauaauauuagagagaaaacacuaagccugcaaaaagaaagugacuuucaaggacuaccucucuggcuagcacaauauguaguuuauggaagacacuccgaagcgucaguagcaggaaaauggaacagcguugacgauauugaagaauaucuuaaagaguucaaacaacauucacucagaaauccaaucguggaacaaguaauaauggaaacaguaagaguagucaaagauauuuggauuaaauauggcaacggagccgcagacuuuuucgaugaaauacauauagaacucggacgagaaaugaaacucccagcgaaagaaagaaacaagaugacacaaaagauaagcgaaaacgaaaacacaaaucuacgaauuaaggcauuacuggcagaaaugaugaaugacucagaaguacaaaacguucgaccauacagcccaaugcaacaagaaauauuaaaaauuuacgaagauggagcuuuaaauagugaaauaucaguagacgaugauauacugaaaauaucaaaaacagcacaaccuaguccaucagaucucaagaaauauaaauuauggcuggaacaaaaauacaggucucccuacacaggagauauaauaccucuuaauaaacuauuuacaacagaauaugaaauagaacauauuauaccccaaucacgguauuuugacgacagcuuuagcaacaaagugauaugcgagagcuuaguaaaccgucugaaagacaacuacauaggcuuaggauuuaucaaacaauuucauggauauaaaauaucggauaaaacaaaaguuuuugaaguggaagaauaugaagauuuugucaagaaaaacuacgcuaauaauaggucuaaacguaguaaacucuuacuagaagaaaucccagaagaaaugaucgaacgccaacuaaaugauacaagauacauaucaaaauacauuagcggaaucuuguccaauauaguaaggaagaaagaaaaugacgaaggaguaaacucuaaagacauuaucccugggaauggcaaaauaacgucacaacuuaaacaagacuggggacuaaaugacguauggaaugacuuaaucuuaccacgauucgaaagaaugaacgaguuaaccaaaucaagcuacuucacagucuggaaugaaaaauaccaaaaauuuuugccaacagucccgguagaguucucuaaaggcuucagcaagaaacgaauagaccauagacaccacgcauuagacgcccucguaauagcuugugccacaaaagaccacgugaaccuucucaacaauaaaucagcuaaaagcgaaaugaaaagauaugaccucaaacgaaaacuuaugaaauuugaaaagaaaacauaucaacacucgcagacuggagaacgaauagucaaagaugugccuguagaguuucuaaaaccguggaaugacuuuaccgucgaagcaaaagaaaaucuagagaaaauaauaguaucauucaagcaaaaccuaagaguuaucaacaaagcaaccaaccauuaugaaaaauggauagaaaaggacaauguaaaaguuaaaggacugguagaacaacaaggacuaaauugggcaaucagaaaaccauugcauaaagacaccguaucaggaaaaguagacuuacccggaauaaagguccccaagggaaaaauauuaacggcaacgagaaaaucaauugacacuucuuuugaccuaaagacaaucaacuccauuacugacacaggaguacagaaaauauuaaagaauuaccuagaauauaagggcaauucaucagaagaagccuuuaguucagagggaauagaagauaugaauaacaauauagaaaaauucaacgaaggaaaacugcaccaaccaauaacgaaaguaagaauauuugaacuaggaagcaaauuuccacuaggacaaauagguaauaagaaacacaaauacguagaaacagcaaaagguacaaaucuauucuucgccauauaugaagaugauaaagggaaaagaacauacgaaacgauaccacugaaugaaguaauagagcgacaaaaacaaggcuuagccccuguaacgcugaaauccaaaaaugacuuuuacuuaugcccaaacgaccuagucuauguugcagccgaaggugaaucaguaaacaaaaucgacuuuaaauacgcuucccaagaguucauccacaacauauacaagguuguaucauuuuccggaucgcaaauauuuuucguaaaacaaaacauugccguuucgauaguuaauaaagcugaauuuucaacuuuaaauaaaauggaaagagcgguagauggaaaaaugauaaaagacugcuguauuaaacuaaaaauagacagaauaggaaacauaaccaaaagcuga

SEQ ID NO: 9111 - RNA, 4239 nt, Artificial Sequence
  Cas9 variant
augaugacgaagaacauuuuaggacuagaucuuggaacaaacagcauaggaugggcauuaauaaaacaaaaugcugaagaacgcaagggaagcauacuaggcauggggacgagaguacuaccaaugucacaagaugcacuaggggacuucggaaaaggcaauucaguaucacaaacggcagcgagaacagguuauagaggugucaggaggcuccgugaacgauuccuacuacguagagaacgucuucaccgaguacuaaacauucuuggauuucuaccugacuacuacgcugcccaaauagauuucgauaaacgauucggcaaauuuaaagcagaaaccgaaccuaaacugccguacaauaaugaggguuuuaucuuuaaaaacagcuuugaagaaaugcuaagugacuuuaagauaucccaaccagaauuacucucagaaaacaagaaaauaccauacgacuggacuauuuacuacuuacgaaaaaaagcaguaagucaaagaauagaaaaggaggagcuaguauggauauuacuaaauuucaaccaaaaaagaggcuauuaccaauuaaggggagaagacuucgaugaagagaaagacaaaacguuuguuacuuugaacguagacaaagucaucgauucaggugaaaaaguaaaaggaauaguauuauucgacguauauuuuacuaauggauggaaauacgaaaaacagauaacaaagccagaagacuggcuaggcagaucaaaagaauucauaaucacugaaaguuuauuaaaaaacggggaagugaagaggacauuuaaagccguagauagugaaaaagauuggauugcaauaaaagccaaaacggaacaggaaauagagauagcucauaaaacaguaggaucauacauauacgaugcuauauuacaaaauccaaaacagaaaaucaaaggaaaacuuauacguacaaucgagagaaaauucuauaaggaagaacuccgcaaaauacuagaaaaacagaaagaauuccaucccgaacuacagaaugaagaccuauacuccgauugcgucagagaauuauaucgaaauaaugacgcacaucaacuuucccuugcaaaaaaggauuuuauucauuuauucguggaagacauuauauucuaccagcgcccacugaaaagccaaaaaucauccgucagcaauugcacacucgaaugccgaaaauauaaagauaaaaauggcgaagaaagaauacaguuucuuaaaguuauaccaaaauccaacccauacuaucaagaauuccgaaucuggcaauggaugucgaauuuaaaaauuuacagaagagaugaugauguaaauaucaccucagaauaucuaaaaacgacagaagacuaucaagaccuauucguguuucuaaauacuagaaaagaaguagaucaaaaagcaugcuuaaagcacuuuaaauuaaacgaaaaaacccauagauggaauuacgucgaggauaagagauauccuugcaaugaaaccggaacaaugauauuagaaagauucaagaaaguuggcgacagcgcagauaacaucuucaccagagagauggaacaacagauguggcacauaaucuauucggucaacgacaagacagaauaugaaaaagcuuuaaaaucauucgcuaaaaaaaaugaccuagauaauguaucauucuuugaagcguuuagaaaauuucccccuuuugacucagaauacgggucuuuuucagaaaaggcaauuaaaaaacuccuaccuuuaauuagaacgggaaaauauuggaacugggaagcaguagacgaaaaaacaaaaaaacgaauacaaaagaugauaaccggggaaugggacgaagacauaaaagauaacauacgagaaaaaacccuaucuuuacagaaagaaucagauuuucaaggacuaccacucuggcuagcacaguaugcggucuauggaagacauagugaagcauccguagcaggaaaauggaauucgguaaaugacauggaagaauaccucaaagaauucaaacaacacucacuccgaaauccuauaguagagcaaguuauuacagagacaauaagaguagucaaggacauauggauaaaauacggaaacggagcagcugauuucuuuaaugaaauacacauagaacuagguagagaaaugaaauuacccgcgaaagaacgaagcaaaaugacacaaaaaauaagcgaaaacgagaacacaaauuuaagaauaaaggcauuacuaguagaaaugaugaacgacagugaaguacacaauguaaggcccuauuccccaaugcaacaagaaauauuaaagaucuacgaagauggugcacuaaauuccgaaauaucugucgacgacgacauauuaaaaaucagcaaaacagcacaaccuucacccagcgaccuuaaaaaguauaaauuauggcuggaacaaaaguaucgcagcccauacacaggagacauaauuccucuaaauaaacuauuuacaacagaauacgagauugagcacaucauaccgcaauccagauacuuugacgacucguuuucgaacaaagucauaugcgaaucauccgucaaucgacuaaaagauaauuacauaggucuaggguuuauaaagcaauuccauggcuauaaaauuagugauaaaacaaaaguuuucgaaguagaagaauacgaagacuuugucaagaaaaacuacgcaagcaauuggaguaaaagaagcaaacuacuacucgaggaaauaccagaagaaaugauagagagacaauuaaacgauacuagauauauaucaaaguacaucagcggaauacucaguaauauagucaggaaaaaagaaaaugacgacggagucaauucaaaagauauaauaccaggcaacggaaaaauuacaagccaguuaaaacaagacugggguuuaaaugauguauggaaugaucuaguacuaccaagauuugaaagaaugaacgaacuaaccaaaagcaacgacuuuacaguauggaacgaaaaguaccaaaaauuuuuaccaacaguaccaguggaauucucaaaaggauuuucaaaaaagagaauagaccauaggcaccaugcucuagacgcacucguaauugcuugcgccacucgggaccaugugaauuuguuaaauaaucaauccgcaagguccgaaaugaaacgauaugauuugaaaaggaaauuaaugaaauucgaaaaaaaagccuaucaacacucacaaaccggggaaagaauagucaaagacguaccagucgaauucuuaaaacccugggacaauuucaucguagaagcgaaagaaaaucuagauagaauaaucguaucauuuaagcaaaaccuaagaguaauuaacaaagcaacaaaccacuaugagaaauggauagaaaagaauaacgucaaaguaaaagcccuaguagaacaacaaggucucaauugggccauacguaaaccguuacacaaagauacagucucaggcaaaguagaccuaccuggaacaaaaguaccuaagggaaaaauacuuacagcuacgagaaaaaguauugacacaagcuucgauaugaaaaccauaaacaguauaacagauaccgggauucaaaaaauacugaaaaacuaucuagaauacaaagguaguuacgaagaugcuuucagcccggaagguauagaggauaugaauaaaaacaucgaaaaauuuaaugauggcaaacaacaucaaccaaucauaaagguuagaauauuugaacuagguucuaaauuuccacuagggcaaauaggcaacaaaaaacacaaauacguagaaacagcgaaaggcacaaaccuauucuucgcuauauacgaagaugacaaaggaaaaagaacauacgagacaaucccucuaaaugaaguaauagaaagacaaaaacaaggacucgccccaguaaccuucaaaucuaaaaaugacuucuaucuuagcccaaacgaccucguguauguagcagcagaaggagaauccguugauaaccuugacuuucaaucagacagucaagaauauauaaacaacguauacaaggucgugucauucaguggcucucaaaucuucuucguaaaacaaaacguagcgguuucaaucguaaauaaagcggaauuuagcacgcuaaacaaaauggaaagagcaaucgacggaagaaugaucaaggaauguugcguaaaauugaaaaucgaucgaaucggaaauaugacuaaaaguuga

SEQ ID NO: 9112 - RNA, 4245 nt, Artificial Sequence
  Cas9 variant
augaagaaaaucuuagguuuagaccuuggcacuaacucaaucggaugggcauuuguagaagaagcagaaaaugaaucagaaaaauccuccauuauaaaacuagggguuagaguaaauccauuaacaguggaugaacagcaaaacuucgagaaagggaaaucuauaacgacgaacgcagaccgaacgcucaaaagaaguaugagacgcaauuuacaaagauacaaacaacgacgagagaauuuaaucgacauacucaugaaaaauggauucacaucugaugauacaauccuaucggaaaacgguaaccguacaacauucgaaacguaccgcuuaaggagcaaagcaguugcagaaaagauaucucuacaagaguuugccagaguacugcuaaugauaaauaagaaaagaggcuacaaaucuucaagaaaagcaaaagggaccgaggauggagaauuaauagauggaauggaaguggcaaagaaacuauacaauuauaaccuaacacccggacaacucugccuacaauuauuaaaugagggaaagaaacacuuaccggauuuuuauagaagcgaucuacaagcagaguucgacaggauauucgacauccaaaugacuuuuuacacugaauaucuaacauuagaacugaaagaagaauuacgaggcaagaaacgcgaugcaguuugggcuauuugcgcaaaaauauuuaaagaaaaaggauucgagcugaucgguacaaaaagacaagguuccacagcagaacaaaaacaugaaaacuacucuuggagagcaaaaggauuaucugaaaaauuagaacuugaacaguuagucguuguauuacaacaaauaaacauacaacuaaauucuuccuccggauaccuaggcgcaauuagcgaucgaagcaaagaacuauuuuucaauaaacagaccguaggccaauaccaaauggcugucuuagauaaaaaucccaaugcaggauuacgaaacaugguuuucuauaggcaagacuacuuagacgaguucaaugcaauaugggaaaaacaagcucuauuucauccuauccuaacagauacacucaaagacgaaauaagagacguaauaauuuucuaucaaagacgccuaaaaagucaaaaaggacuaauuagcuucugugaacuagagucaagaaaaauagagguagaaauagcaggacaaaauaaaacgaaaauggucggaaguagaguaauaccaagaucuucuccgcuauuucaagaguucaaaauauggcaaucauuaaauaauauagaaguauucggcaaaggcaagaaaucuaagaaacaaaaagaacaaacgcuauuugaccaaaccgaagacccucuagaauuuggaggucgucgcgaauuauaugaagaagaaaaagaauuacuggccuuagaacuaagcauaaagaaagaauuaaagaaagcagauauacugaaacuucuauuugauaacccgaaagaauuagaccuuaacuucaaugcaguacaaggaaauuuaacucaagcaacacuauuuaacguauacaagaaaauaauagaacuaucaggacacgaaauagacgucgaaaaagauucagcaaguaaaauauuaaaaucaauagaagaaaucuucaaagccuuaaacuauaacacagaaauccuacacuucgauagcgaaaaaucgcaggaccaacaggcaauguauaugcuauggcaccuacuuuauucauucgaaggcgacaauagcaauacgggcaacgaaaaucucauaaacaaaauuucaaaauuauacggguuugaaaaagaauacgcuaaaauacuagcaaacguauccuuucaagacgauuauggaagucugucagccaaagcaauaagcaaaauccucccauaucuuaaagaaggccacaaaagcgacauagcaugcgaucuagcugguuacaaacauucagcguccucacucacgagggaagaauuagaaaauaaaacauauaaagacagacuagaaauauuaccuaaaaacacacuaagaaacccaguaguugagaaaauacuaaaucaaaugauaaacguaauaaacuuaauuauagacagcagagaacuaaagaaauccgcaaaagaacgugaggaacucaccaaauccauaucagagaccacaaaacuucaucaacaauacaaagauauauuagccaaagcaccauucaaccugacuaacacaucacgaaaugacauaauaagauacaaacuauacgaagaacuaaaagauaacggauauaaaacacucuauucaaauaaauacauaucgccagccgcuuuauuuuccggugauuucgauaucgaacauaucauaccucaaagucgacuauuugacgauuccuuuagcaacaaaacacuagaacuccgcuccauuaacauagaaaaagggaacaaaacugccuacgacuuuauaaaaggaaaauacggagaaacaggagaagauaauugccuagacaaauacuuaaauagaauagaaacucuauacaaaaacggaauacuaaagaaaucaaaauacaauaaauuaaaaaugcaggauaaagauauuccugauggcuuuauagaaagagauauuagagacacacaauauauugccaaauacgcuaaaacucuacuuggugaccuagucaaauucgucguaagcacaucggguagcguaacagaaagacucagagaggacuggcagcuaguugauguaaugaaagaauugaacugggaaaaauacaugcaacucgguuuaacagaagaguuuacaaaugaggaaggacaucgcauucgcaaaauaaaagacuggaccaaaaggaaugaucaucgacaccaugcuauggaugcauuaacaguagcuuucacuaaaaggcaauuuauacaauauuuaaacaaccuaaacgcaagaaggauaucagacgaacaaggaauuuccaauagugagaaagacgaaagaaacaacguaucaauaaccacuaaugauaugaaauugaacacucgcgauguguuaggcauugaaaagaaagaacucuauagagacaacagaggaaaacuacgauucaaagcaccaaugccacuacucgaauuuagagaggaagcaaaaagacaccuagaaaauaccuuaauaucaaucaaagccaaaaacaaaguuacaaccauaaacauaaauacacuaaagaaagcaggaggaguauacaagaaaacccaacuaaccccaagaggacaacuacauaaugaaacuaucuacggaagucaaaaacaauauauugucaaagaagaaacgauuaacgcaaaauucgauguggagaaaauagcaaccguuaccaauccaguuuacagggaagcacuccuaaaaaggcucgaacaaaacaauaacgaucccaagaaagccuuuacaggaagcaacgcacucaccaagaaacccaugugguuugacgaacaacaaacugaaaaagucccagaaaaaguuaaaacuguuaguuucgaaacuauauacacgaucagaaaagaaaucagccccgaucuaaaaauagaaaaaguaguagaugagaaaguaagacaaauccuuaacaacagacuaaaugaauauaauggaaacgcaaaacaggcguucucaaaccuugacgaaaacccaauaugguuaaauaaagaaaaaggaauaacaauaaaaagaguaacaauaacugggauaaauaacgcacaagcacuucaugaaaaacucgauaaggacggaaaaccaauuuuagacggugaagguaagaaacaaccaguagacuuuguaaacacaggaaacaaucaucauguggcagucuauugcgaugcagacggaaaccuucaagaaaacguaauuucguuuuaugaagcaguuacccgacgaaaucuaggccuaccaauaaucgacaaagauuauaagaaagacgaugguuggcaauuuuuauuuaguaugaagcagaaugaauacuucguauuuccaaacgaaucgacaggguucaauccaaaugaaguggaucugcucaacccugauaauuauucauuaaucagcccaaaucuauucagaguacaaaaguucacaauaaaagauuauuucuuucgccaccauuuagaaacgaauguugaaucaaacuccacccugaaaggcauaacaugguuaagaugcggacuaaacaauauagauaacauaauaaaagucagaauuaaccauaucggacaaauaauucauguuggagaauauuga

SEQ ID NO: 9113 - RNA, 4248 nt, Artificial Sequence
  Cas9 variant
auggcuaaauucaauaaaccuuacucuauaggucuagauauagguguuucaucaguaggcuaugccguuauaacugaggacuacaggguaccagcauuuagauucaaaguauuaggcaauacugagaaagagaaaaucaagaaaaaucugauaggcucaaccacuuucguacccgcacaauccgcccaaguaaccaggguauuucgaguaaaccgaagaaggauagacagaagaaaucauagaauugcauaccuaagagacaucuuucaaaaagaaauagaaaaaguagacaaaaauuucuaucgaagauuagacgaauccuuucgaguacuaggagacaaaagcgaagauuuacaaauaaaacaaccuuucuucggagacaaagaacuagaaacugcauaccauaagaaauacccaacaauauaucaucuuagaaaacaucuagcagaugcagacaaaaacagcccaguugcagacauaagagaaguuuacauggcgcuuucccauauucuuaaauauagagggcacuuucucacacuagacaaaauuaauccuaacaauauuaauaugcaaaacuccuggauuaauuucauugaaucaugccaagaaguguucgaccuagaaguaucagaagaaucuaaaacaaucgccgcaauuuucaaaucaucagaaaacagacaagaaaaagucaaacaaauacuaaguuacuuccaacaagagcuucuaaagaaagacaaaucaauauucaaacaacuacuucagcuauuauucggacucaaaacaaaauucaaagauuguuucgaacuggaagaagaaccugacuuaaauuucucgaaagagaacuaugacgaaaaccuagaaaaccuacuaggcacauuagaagaagacuucagugacguuuuugcaaaacuaaaaauauuaagagacacaauccuacucagugauauguuaaccuauacaggugccacucacgcacguuucuccgcgacuaugguagagagauacgaagaacaucguaaagauuuacaaagauucaaauccuuugucaaacaaaacuuaucagaacaagauuauuuagacauauuuggccgaaaaacccccaauggauuugacguagacaaagaaacaaaaggauacgucgguuauauaucuaacaaaaugguauuaacaaauaaacagaaaacaauacaacaaaacuucuaugacuacauuucuggaaaaaucacugggauugaaggcgccgaauacuuucucaacaaaaucucagauggaacauuuuuaagaaagcuacgaaccacugacaacggagcuauaccuaaccaaauacacgccuaugaauuagaaaagauaauugaaagacaagggcgagauuacccauuccuuuuagaaaacaaagacaaacuauuauccauacuaaccuuuaaaauucccuauuacguugguccauuagcuaaaggaaacaauagccgauuugcauggauaaaacgagcaacaucccaagacauucuagaugacaacgacgaagauacaagaaauggaaaaaucagaccauggaacuaccacaaacuuaucaacauggauaagacacgagaugcuuuuauaacaaacuuaauaggaaaugauaucauuuuacuaaacgaaaaaguccuuccaaaaagaucacucaucuaugaagaaguuauguugcaaaacgaauuaacaagggugaaauacaaggacaaauauggaaaaacgcacuucuucgacucugaacuucgccaagaaauaauuaacaauuuauucaaaacaaacucaaaaagagugucuuccgccauguuacuaaauuaccuagaaaacuauaccaacuugcaagccguagaaaucguaucugggaucgaaaaagguaagucauuaaauucaacacuaaaaacauacaaugaucugaaaacaaucuucucagaagaacucuuagacuccgaaauauaccagaaagaacuagaagaaauagugaaggucauaacaguauuugaugacaagaaaagcauuaaaaauuaucuaacgaaauauuuuggacgacucgaguuccuaaacgaagaacgaauaaaccaacuuagcaaacuaagauauacaggauggggacguuauagcgcuaaacuacuacucgauauaagagacgaagauacuggauucaaucuaaugcaauucuugagaaaugaugaugaaaaucguaaucuaagccaauuaauaucagacagcacccuuucauucgauucagcaauuaaaucaauccaaagcaaaagcacggucgaagaugacguuuuugacgaaauaaagaaauuggcuggauccccagcaauaaaacgugggauucucaauucgauuaaaauagucgacgaauuaguacaaauaauaggauacccaccucaaaacauuguaaucgaaauggcacgagaaaauaugacuacagaagaaggucaaaagaaagcaaaaacaagaaaaacuaaauuagaaucugcacuuaaaaauauugaaaauucaguauuagagaacggaaaaguaccacacucagaugaacaauugcaaagugagaaacuauacuuauauuauuuacaaaaugguaaagauauguacagcuuagacaaaacugggucacccacuccccuauaucgagaucgacuugaccaauacgaaguugaccauauaaucccauauagcuuccucccaaucgauucuauagacaacaaagucuugacgcauagagaaaacaaucaaagaaaacuuaacaacauaccugauaaagaaacgguugcaaacaugaaaccguuuugggaaaaauuauauaacgcgaagcucauaucacaaaccaaauaccagagacugacaaccucagaacgaaccccagauggaguauuaacugaaucaaugaaagcaggauuuauagaaagacaauugguggaaacaagacaaauuauaaaacaugucgcacgaauacucgauaacagguuucuagacacaaagauuauuacauuaaaaucacaacugaucacaaacuuuaggaauacauuccacauagcuaaaauacgcgaacucaacgauuaccaccaugcacaugacgcuuaucuugcgguaguaaucggacaaacccuguuaaaagccuacccgaaguuggcgccggaauuaauauacggccaccacgcccacuuuaauaggcacgaagaaaauaaagcaacuauaaggaagcaccucuauaguaauauuaugcgauucuuuaacaaucccaauagcaaaguuucuaaagacaucuggaacugcaacagagaucuaccaauuauuaaagacauuauuuacaauucgcaaguuaacuuuguaaaacgaacaaugaucaagaaaggcgcauuuuauaaacaaaacauaauacccaacgacucuucaguuacaguggacaaacgcuuuccuauuaaaaacaagaaauaccuagacccaaaacuauacgggggcuacuaugaaagaaacagcgcacuaucagucuuuauaaucggacagagcuucaacaaaaauaauaaauuaaaaguuguaaaagaauuuuaugauauaaacaucauugauuauccccuuuuuaacacugauccaaugucauucuucaacgacgauucagaaaacgguuuccuuaccaaaaauaaccuucaaucuguacaagcguucuauaaaauaccaaaauacucucuaauacagaaaaacgacggaacacgaaugcuauucgaaagcacaacaaacuuucauaaagcgacacaauuuaaacucacagaagcacaaaacgaacucuucuuucauaugaaaagacucuuaacaaaaacagacuuuauggaccucaaaucagaagaaucaaucaaagaaucacaagauuucauuaugaaucacaaaaaugaguucgacaauauaguaaacggcuuauuuggcuacgcggaacgacaacuuggguccaaaucauuauuuacucaagcacacgaagcauacaaacuaagaaaauauccuguauuuucauuaaaugaagaaacuauaagauauuacuacgacaacuuucuacgauuauuuucacuaacaaaauccggcacaagcucaggauauguaguuggauuauuugaagcuccaaaacuaagaaacguagucuauagagcaacaaaagacgaaucgaaugcgacuuuaauccaucaaucaaucacaggacuauaugagacacgaauagaccuaucaaaacucggggaagacuga

SEQ ID NO: 9114 - RNA, 4248 nt, Artificial Sequence
  Cas9 variant
augaacuuacgcaauguagcaaaagaagggauaaacuauaacauaggauuagauuuaggaacagguucuguaggaugggccguaacugaugaacaaggagaacuuuuuucuuucaaaggaaagacaaccugggguagcagaauauucccgaccgcagaaaccgcagcagauacaagacuaaaaagaggacaaagaagaagauacgcgcgaagacgauggcgcuuggauuuguuacaauccuuauucgaggaagaaauuaaaaaaguagauccagaguucuuuacgcgacuuaggcaaucccauuuacuuaaagaggauaaaacauaugcagcgauuuuaucaucaaaaggagcaacacgaccauuauuuccagaaggagaagcagaaguggaauacuauaaaaaauacccaaccauauaucauuuacgaaaagcgcucauggagucaaacaaucaagaagauauucguuugauauaucuugcauuucacaacauaguaaaagcccgcgggaacuucuuacaccaagacacgccagguuuaacagcaagcaaugcaaacaugggggaugcaguggaaaaauuguguucggcccuagaagauuggugcucaucacaaaacauagagugugcuauaagaaaaaaccagaaaucuauacaagaccuuauggaaggaaaaaccauagaaccaucagaaaguaacgcauuaaaagaaaccuucgacgcaucacgaaguagcaggaaggauaaagcaucugugcuagcaggauggauagcaauccaaccaggugaacaauuugaaccgaaacaggcuaaagacgcuucaaaggaaauagcaaaugcagucuuugggcugagcgccaauaugaaaaaagucuucguggaauuagaagaagaucaaaaaauuuacuuaaacaacgacgagcaaguugaagcauuuuauacugucugcccagacgagggaguagcucuuuuugaggcacuacaauccauguacucggcguaugucuugauggguauauuaaaaggagcugaugggggaagcaucucgucaugcaaaguagcagcauaugaacaauacaaagaagauuuaaaacuuuuaaaaacacuuguaagagaauuugcucccaaaaaguacgacgaguucuucagaggagacauauuugaugcgaaaaaaggcuucagaacuaggaacuaugacccagcaacagccaaagguuauacaaaauauaacucuguuagaggagcuucuuacgaugccuucaagaaagaaguugaaaaacucuuugaaggaacagcggccgaagaagauguuagguauacugauaugaugcaaagauuugaugagggcacguuucuuagaagauuaaaaacaucugauaacggaaguauuccauaucaauugcaccuugaagaaaugguggcuauaauugaaaaucaaaaaacauuuuauccguuuuuagaagaaaacaaagaaaaauuugaaucauuaguaacauuucgaauacccuacuacguaggaccauuaacacaaaaaaacgcucgcccagauaaucauggaaaugcacgauuugccuggucccaaagaaaagaagggcaagaaaacgcucguguauauccuuggaacugggaagaaguuauagauagaaaacagagugcagccaaauucauggaaagacuaacaggcacaugcacauacauacucgaagaaccgguauugccaagauacagucuauuauacgaggaauauugccuuuuaaaugagcucaacggagcaagguggagagacaugggaggagauuggcaucguuuugauuaugagacacgaauggauauuaucgaggauuuauucaaaaaaaaaaaaggaacaguaaaauaugcaacaguggcggacuggcucgugcgagaaaaacaccgaaguugugcagaaguaaaaggaggacaaggagaaaccggauuugaaaguaaauuaucgaguuauguauuuuuuaaaggaguuuuacacguagacgaaauugaugaagcggauauaccaaugauagaagagcuuauuugguggaauacauuauuugaagacaggaguauauuaaaagaaaguauagaagacaaauacggugacagacuaaaugacgaacaaauuaaagcgauaugcaaaaagagauucacaggaugggguaggcugucaaaaaaacuuuuaugcgguauuaaagcacaaacagacaauggaccauguagcauuauggauguacuacgagaaggaaauccaaauaaugacgcuagaagcgcaacuauggucuuuauggagauuauuagagaugauaaauuuggcuuuaccaaacucauugaggaagagaauaagaaaagaauuucgaguguagacgauuucgauguaaacgauuuaccuggaucuccagcagugagacgaacgguaaaccaagcuaaaagaauaguagaugagauaguuggaauagcagguugcgcaccacaaaauauauuuaucgaaguaacacgagaugaagacgggagaaacaaaggacggagaacaaaaaggagauaugacgcaauacaagaagcuguuaaaguauuaaaaaaggaacaaaaagaauacuuugaugcuaacguagcagaccucuuaaaaaauacagcaccagccgcauuagacgaugaaaggcuggcucucuauuuuaugcaaaauggcaagugcauguauuguggaaaagaccuggacauuaaccaauuagacaaauaucagguggaucacauacuaccacaaaguuauguuaaagaugacucuuuugaaaacaaagcguuaguacacucagaugacaaucaaagaaaauccaacagcauguuauuagacgacaguauaauccgaaaaaugaagccauacugggaagcacucaggucagcaggccuaauaggagaaaaaaaauucaagaaccuaacgcggguacguguaucggauaaagaacuaggaggauuuauagcacgucaaauggucgaaacuucacaaaguaugaaacuaacaucguuauuacuagaacaagcauauccagaaacacaaguaagaccaguuaaagcagguuuuuccucggacuuaagaaggaggcuaaagcugguaaaaugccgugaaauaaaugacuaccaucaugcacacgacgcauaucuagcaugugaaguaggccaauuuauugcccuacgccauaauaaacuauacgaaaauccaauuggauauagucaugcaguaaaggauuuuauagcaaaaagagcaaaauaugcgagugaacauggcaaaccuauggauacauacggaaugccagggucaaguucauucguaauaucuucuuucaugacaucuggguuugaugaagaaacuggagaaaucuuuaaagacgcaugggacgcuucucuagcagcggucaggauacaccaagcacuaaauaggaaagauuguuauauaucuagaaugccagaagaaacaucaggagcauucugggacgcaacaaucuauucaccaaaacaaacaaaaaaaaaguuaucacuaccauuaaaaaaagggcuggacccgcaaaaauacggaagcuauaguagagaacaauuugcauauuucuuuguauaugaagcgaagaagauuaaaaagaaggaagaaacuaaagaauauguguuugcuucaguaccagugcaaguagcagcuuuaguagcugcagacccgaaugcacuaaucgaauuugcaaaagcagaugcugaggaaagaggauuaaaauuugccaaaauaguacgagagaagguguacaaguaucagcugauagaaguaaacgaugagagguucuucguaacaggucuaagaacaguaagaaauggacuucaaauugcuuuuagcgaacaagaucgcaauauuguauccgggaucguugaagggaacucaucuaacaauaacuuacuugacauauacgauaaaauaacaaauagauaugcacuauacgcaaguagauuugguaaauuacucaacuugaguggcuacagagaaaauuucauacaagcaucauuggaagaucaggaaagaguugucuuagcauuaauuuccuuguuuaaugcucguacaaauaugauagaucuuucagccauaggaucaagcaaaacuguagguaacaugagcaugacauuugcaaaagaaauggcgauggcugauaacagguuugcauucauugaucagagcguuacagguaugcuagaaagaaagacauacuuauga

SEQ ID NO: 9115 - RNA, 4251 nt, Artificial Sequence
  Cas9 variant
augggaaguagaaucauccccaugucccaagauauacuuggggaauuuggaaaagguaacucaguaucccaaacaagugaaagaacagcuuauagaucgacaaggagguuaagagaaagauucuuacuaagaagagaaagacuacacagaguacuaaauauacucgacuuccuaccuacccauuacgcaagucaaauagauuucaagaaacggcuagguaaauucaaagaaaacaaagaaccgaaaauagcauacgauaauaaaucauucuuauuuuuagauagcuucaacgaaaugcucaaagacuucgaacaagaacaaccuaauaugcucauaaacgaaaaaggagaaaagaaauuaauaccauaugauuggacacuauacuaucuacguaaaaaggcuuuaagagagaaaauuucaaaagaagaacuaaguuggauaauacucaacuucaaccagaaaagaggauauuaucaacuacgcggugaagacgaagaagaaaauccaaguaaauuagucgaauuucauucucuuacaguagucgauguagugccagaugaaccaauaaaaggaaaacucgaaaccugguacagcaucauauuagacaacgguuggguauaccgcagaucuucaaaaacugaacuauaugacuggaaagauaaaauaaaagaauuuauagucacuacggaccuaaacuacgacggaacaguaaaaacagacaaagaagguaacgucaaaagaucauucagagcaccaagugaaaccgacuggacacuuauuaaaaagaaaacugaauaugaaauagaacaaucgaguaaaaccauaggagaauacauauacaacacuuuacuaaaauacccugaacagaaaauacggggaaaauuaaucagaaccauagaaagaaaauacuacaaagaagaauuaaaacaaauauuacuaaaacaaaccgaauuucauaacgaacuaaaagaugacucuuuguauuacgacugccuaagagaacuauacagaaauaaugaaucacaucaacucuuucuugagaagaaaaacuucgcacaauuauuuauagaagacaucauauucuaucaacguccuuuaaggucacagaaaaguuugauuucuaauugcccacuugaguucuauaaauucaaagacaguguaggaaacgaaaaaguacaacacuuaaaagccauaccaaaaagcaaccccuuuuaccaagaauuucgaauauggcaauggauuaguaaucucucaauauauaguaaacuagacgauucuaacuuuaccagccacuuuuucgacuccacugacgauugggaaucauuauuugaaauguuaaauggaagaaaagaaauugagcaaaaacaacuccuaaaauuccuacuugaaaagaaaggauucaaagguaaaucauuaucaucggaaauugaaaaauaccgauggaauuacguagaagauaagaaauauccauguaaugaaacgagaucucuaauucaaucacgacuugacaaaguugcaaacuuacccgaaucauuccuuacucggcacguagaacaagaacucuggcaccucaucuacaguguaacugacaaaauugaguucgagaaagcccuagacacauuuagcaagaaauacaaaauagacacaccaacuuuuguagacgcauuuaagaaauguccaccuuucaaaagcgaguacggaucuuuuucagaaaaagcuaucaagaaauuauuaccauugaugagaacuggaaaauauugggaccucgauaacauagacaaagccacaaaacaacgaauagagaaaauuauaucaggagaauaugauaaagacauuagagauagaguaagagaaaaagcaauaaaucuccuaucugaaacagacuuuaacagacuacaauuauggcuugcucaauacauaguauacgacaggcauucagaagccaccagucuugauaaaugggagacaaucgaugauauagucacuuacuuacacucauucaaacaacacucauuaagaaacccaauugucgaacaaguaauaacagagacuaucaggguagugaaagacauauggagcaauuacggaaauggguccaaagauuacuuuaacgaaauccacguagaauugggaagagaaaugaaacuuccagcugaggaaagaaaacguauucaagagaaaaacucacagaacgaggauacaaaccuuagaauaaaagcgcuccuauccgagaugcagaaugauccaaauguggaaaauguccgaccauauagucccguccaacaggaaauacugaaaauauacgaggagggaguccucaacagcaacauagagauagcugaugauauauuaaaaaucuccaaaaccgcccagccauccuccuccgaucuaaaaagauacaaacugugguuagaacaaaaauaccaaucaccauacacaggagaaaucauaccccuaaauaaauuauucacgccagaauacgaaauugaacauauaaucccccaaucacgauauuuugacgauucauauaauaauaaagucauuugugaaucagcaguuaacaaauuaaaagauaacagccucggguacgaauuuauuaaagguuacaauggacaaauagucgaauguggauuuggcaagaaaguaaaaauauuuuccauagaugaauacgaagauuucguucagaaaaauuaugccaauaaccgcagcaaagcaucccgacucaugauggcugacauacccgaaaagaugaucgaaagacaacucaacgauacacgcuacauauccaaauauaucaguaauauucucuccaacaucguccguuccgaaucuaacgaugauggaguaaacagcaaaaaccugaucuccgucaauggaaagauuacgacaguacuaaagaaagacuggggaaugaaugacauauggaaugacuugauccuaccacguuucauccgaaugaaucagauaacagauagcgacaguuuuacaacauggaacgaacguuuccaaaaauuuauaccaacuguuccuaucgagcuauccaaaaacuuuagugcaaaacguauugaucaucgccaccacgcaauggaugcauuaguaauagccugcgcuacaagagaccacguaaaccuacugaauaacuuauacgcaaaaucaucugcccguuacgaucuaaaucgaaaacuacgcauuuuugagaaaaccacguauaaagauauaaaaacaggacaaauuauagaaagggagauaccaaaagcauuucugaaacccuggcaaaauuuuaccaccgaugcaaaagaugcgaucgaaucaauuauaguaucauacaaacagucacuaaggguaauaaacaaaucaacaaacuacuaccaaaaguggguagaaaaagauggaauaguaaagaaagagaaaauuaaacaagaaggcaaaaacugggcaauaagaaaacccuuacauaaagacacaguguccggauuaguacaacuaagcuggguuaaagucccaaaaggcaagguuaugaccgcaacaagaaaguccuuagacuccuccuucgaccuuaagacgauagcuaccauaaccgacacaggcauucagaaaauucuaauaaaauaucuagaguccaaagggaauaacccagaauccgccuucuccccagaaggcauagaagacuucaacaacaauauacaucuauacaacgaugguaaaaagcaucgaccaauaacaaaagugagacuauacgaaaucggaucaaaauucccacuaggagaaaaaggcaacaaaaaugcaaaauacguagaagcagcgaaagguacaaaccuauucuucgccguauacgcaaacaacaaaggcgaaagaucuuucgaaacaauaccucuaaaccuuguuauagacagauuaaaacuaggacucucugcuguaccagaaacaaacgaaaaaggugauaaucuucuauuucaccuaucgccuaacgaucuaguauaugugccaucagaagaugagauggaaaaccuuaaacucauaaauuuagaacacaucaguaaagaucaacuaaaccgcauauacaaaauggucaguaguaccucaaauagaugcuucuuuauaaaaagugaaauagcccuaucaauaguaaacaaaaucgaauacucuccauuaaauaaaauggaaaaaucaauagaagguaucaugauaaaagacguaugcuuaaaacugcagguuaaccgcauaggaaaucuagaaagguauuuuagcuga

SEQ ID NO: 9116 - RNA, 4257 nt, Artificial Sequence
  Cas9 variant
augaaagucaaaaacauauuaggauuagauauaggaguaacaaguauaggauucgcacacguaacagaaaaugaaaaagacaauaaaagucacauaaaacaguuaggaguacguauaaauccccugaccgucgacgaacaaacgaacuucgaaaaagggagaccagcuuccguaaaugccgacagaacgcugaaacgaggagcaagaaaaauguuaucaagauauaaagauagacguaaaaaccuaauugaaauauuauccaaaacaggauucauaaacuccgaaucgauccuugccgaagacggcaaaaacacgacacacucaacuugggcauuaagagcuaaagccuccagagaaagaauagaaaaagaugaacucggacgcgucuuguuagccauuaacaagaaacgcggcuacaaaucaucacgaaaagccaaaaaugaagaugaaggacaagcuauugauggaauggcuaucgcgaaacguuuauacgaagaaaauuuaaccccaggccaauuaguauaucaacuacuucgagaaggcaagaaauacauaccagacuucuaucgauccgauuuacaagaugaacuagacaaaguauggaacuuucaaaaacaauuucaccaggaaauacuaaccgauaccuuuuacaaagacauacaaggaaaaggccaacgagcaacaucagcaaguuucuaugguguguacggguucaacacggcagaaaauaaaggaucacgggaagagaaaagacuacaagcauacgcauggagaucugaugcccuaaccaaacaguuaacacgugaagaaguagccuucgucauaacggaaaucaacaacaaccuuaacaauucaagcggauacuugggagcaauauccgacagaucaaaagaauuauucuuuaauaagaaaaccguaggccaauauuuauaugaacaacuccaacaaaauccccauacaagacuuaaaaaccaaguauucuaucgacaggacuacuuagaugaauuugaaacgauauggacaauacaaagcagauauuauccagaauuaacagacgacuuaaaaagagaaaucagagacguugucauauuuuaccaacguaaauuaaaaagucaaaaaggccuaguaucuuucugugaacuagaaucaaaagaaauuaugauagagaaaaauggaaaagcggcaguaaagaaaauaggaaguaaaguggcuccuaaaucgagcccgcuauuccaagaguucaaaauuuggcagguacuccacaauguagacaucaaaaacaagaaagauaaaacaaaacgaccccuagaugacucugaaaaagaauaccuauuuaacgaacuuaacauuaaaggaaaucuaaaagccgcuaaaguuauucaauuauuaacgcuaaauaaaaaugaaacagaacuaaauuauacacaacucgaaggaaaccgaacucaaaaagcacucuacgaagcauaucuaaaaauauuagacaccgaaggguacgauguaaauaauuuacuuggcaucaaaagcaacaaagacgaaguguucuuagacgacuuagacguaaaugcauuagaaauuaaaaccaugaucaaacaaauuuuuaacgccuuaaacaucaacacgggaauacuagacuucgacgccgaacuggacggaaaagcguuugaacaacaagcaagcuaccaccuuuggcaucuauuauauucuuaugaagaagauggaucaaaaaguggaaaugaacaccuauauaaacuucuagaaaacaaauucggguuuaaacccgaacaugcacgcauauuggcgggaauaacucucagcgaugacuauggaaacuuaagcgcaaaagcaaugagaaaaauauacccacaaauaaaagaaaacaauuuuuccacugcaugcgaguuaguaggauaucgucauagcaaaaauagucuaacaaaggaagaaaaucaagaaagaccuuuaaagaauaaauuagaacuccucaagaaaaacagccuaagacaaccugucguagagaaaauuuuaaaccaaaugauaaaccucguuaaugaacuaaucgauaaaaauucggaaaaagacgaacaaggaagcauuaucgaauauuucagguucgaugaaauaagaauagaacuagcaagagaauuaaagaaaaacaccgaugaacgaagagaccuagacgcugccauuagagaaggaaaccuaagaaacgagaaaauauacaaauuacuacaagcccaauuugggauuaaaaacccgacuagaaaugacauaauaagauaucgacuauaugaagaacuuaaaaacaacgguuacaaagaccuauauacaaacucauauauaccacaagaaaaauuguucggaaaagaaauagauauugaccacauaauaccacaaaguaaacuuuuugacgacagcuuuaguaacaaaacauuaaccuacaacacuacuaacaaagauaaaggaaaccaaaccggcuuugacuauauagagucuaaauauggaauagauggcaucgaggcuuauacggcacgaauagaaaaucuauucgaaaguggaaagaaaaauaaagaagaaggaguuucgaaagcaaaauaucaaaaauuacuaaagaaagaaucagaaauaggagauggauucauagaacgagaucugagagaaagucaauauauagccaagaaagcgaaagaacuauuacugcaaauuacgcgaagcguagucgccacaagcggaucuauaacugcaagauuacgagaagauugggaucuagucaacgucaugaaagaacuuaaucuaccgaaauaucgcgcacuagguuuaacugaaauggaagaaaggaaauauggacaaaaaguagaaguaauuaaagauuggacaaaacgagaugaccauagacaucacgcaauggaugcacuaacgauugcauucacuaaacacaaucacauacaauaccucaaccaccugaaugcucgaaaagacgaacaacauaaagaacauaaaaucauaaacgcaauugaaaacaaagaaacuauauuaauaacagauaaaagcggcaacaggaaacgaguauuuaaagccccaaugcccaauuucaggcagacugccaaacaauauuuagaggagguacucauuucucacaaagccaaaaacaaggugguaaccaaaaacaaaaauaaaauccuugguaaagagaaaauacaagaaacauuaacaccgcgaggacaauuacaugaccaaaccaucuauggauucaacugguggagucguauuacacuaaguaaaaagguaucacgcaacgaaauagagaaaauuaucgauaauaacacgaaauucuuuuuacaagaauuuauucaacuuaaaggcucaaucgcgaaagcauucagcgaugcagaauuaaauaaacucauguauaaaggaaaaauacuaaaagaaauugaaguagcaauaccuuguuauacacaacgaauagacaucucgaaaguauucacagauagucagaaaaguaauagugcaaaagaaaagaacaucaaaaacauacucgaucucaaaguacgaaacauccuacaaaauaggcuuuccgaguucaaaggagauuuuaagaaagcauucuccgaccuagacaaaaacccaaucugguucaacaaagaaaagggaaucagcaucaagagaguaauuauaucaggcgucaaaaacguagaaccuuugcacuauaagaaagaccaccugggaaacgauauacuagauggaaaagaaaaucgaaucccuguugacuuuaucuccacaggaaauaaccaucaugucgcgauauaccaagacgaaaaaggcaaccuacaagaaaaagucgucucucucuucgacgcgguaaagcuagucaaugcagacgaaccaguaaucgacaagaccuauaaucaaggauuaggauggcaauucuuauucacaaugaaacagaaugagauguucgucuucccaaacgacaacacuggauucgacccaaaagaaauagaccuccucgacccaagcaauaagaaauuaauuucucccaacuuguucagaguacagagcauaucaaucgugcaauacggaaauaauauaguacgagauuucaaauuuaggaaucaccuugaaagcguuuuaaacgaugacaagguucuucacggcauaacauuccaacaaauaaaaucauugggaccucuccuaaauauaguaaaaguccgaauaaaccaccuaggagacaucgucucaguaggagaauacuga

SEQ ID NO: 9117 - RNA, 4260 nt, Artificial Sequence
  Cas9 variant
auggcaaaaccacaaaacuauaccauuggauuagacauaggaacuaacagcgucggauggacuguaacggaugaccaaaauaacauucuacgaauaaaaaguaagaaagcgaucggugcaagacucuuugaagaaggaaaaguagcggcagaaagacguucauucagaaccacacgaagacgauuaaguagacgaaaauggcgaaucaaauuacuagaagaauuauucgacgaagagauaucuaaaguagacccaaacuucuuugcacguucacaugaaucauggauaaguccuaaagauaaaagggagagguauucagcaauugucuuucccaccccggaagaggacaagaaauuucacaacgaguacccaacuauuuaucaucuacgcgacagacuuaugaaagaugaccaaaaacacgacauaagagagauauacguagcaauucaccacauaaugaaauaucgagguaacuuucuacaugaugagaguaucgagacuuaccgaagcgguaugucaucauugggaggaggcgaugagagaacaauacuaaauacaaaaauuuuagaugauuuaaaugaugcuuucgccgacaauuuagcgacccaggguaucuccguaaacagugcuagugcugaccaaauuaacgaaauaguuacaucaggacacuuaaaugucgacagccaaaaagcaauagcuaaauuauuacuacccacaacauuaucaagugacgacaagaaacaggacaagaaaauuaagaaauuggccacagacgcagccaaaaacgucgcaagugcauggcuaggauacaaagcaaacuucgcagcuauucucaacauucaagagguugauaaagauaagaagaaaauauauucuuucgcacuccaaggagcagacgaagaagauaaagucgaaacuuuagaaucaguauuaucacaagaccaaaucgaaauaguggauagaauaauaagaauaaggcacgcaauaguucuaggagagaucauaccgguaggaaugacauuaagcgaggcuaugauagaaaaauaugaucagcacgcaaaagaucuaaagaaccuaaaaaccguaaucagaaacuuaaaagaucguaaaaacgcgguaaaacuacaagcaauauaugaucucuaugugaacaacagacaugccgauaccgcaaaagcuaugaaacuagcuggcguuaagaaacgaaccgaacuacucgaaccagaggaauuuaauaaaagcauagaaaaauuauuggacgacaguccaguauccgccgaaauaaagaaacgcaucgcagaaaaagacuuccuaccacuacaaagaaguaauuccaacgggguuauaccuaaccaauuacaucaaaucgaacuagaugagauuaucaagaaacaaucaaaauacuauccauuucucggugaaacuaaugaacacgcgagcgcagauguugcuagaaaagcgccaacaaaauuggaccaacuccuaacuuuuagaguuccuuauuacguaggaccucuaauuacaaaagaagaacaagaagaacaagauggucauucauuugccuggaugauacgcaaaaaucccaaagaucacgagaaaauaacaccguggaacuuugaugaaaaaguagacagaauggcaagugcgacccaguucauaaaacgaaugaccacaaaagacacuuacuuacuaggagaagauguacuaccaucauccagucuuaaauaucaauuauucacaguacuaaacgaauuaaauaaucuucggauuaaucauaagaaauuaacacgagaagaaaaagaacaagucauugaagaucuauuuaagaaauacaaaacagucaaagccgauaaauuuaaaaauuauuggcaaaaaggacacgcuggacuagacgucaaaauccaagguauggcagacccagaaaaauuuaacagcacaaugucgacauauaucgaccuacagaaaauauucggggaucaacuagacgaugcacaaaggcaaaacgacuucgagaaaaucaucgaauauucuacaauauucgaagacaggaaaauuuuaggggaaaaauuaagagcggacuuuguauggcuuagugaagaucaaauaaaaagauuaugccgacuccgauuacaggguugggggcguuuaagucuuaaacuguugacacgccucacugacgcagauggucaaaacguauuagaaagacuauuaaacaguaaugacaauuucaugcaaaucguaaaagacccaguuaucaaagcuaaaauugaacagaaaaaucaaaaauuauuaagagccgauuggucagagaaugcaacagaauccauacuagaugaggcauauacaaguccacaaaauaagaaagcaauaagacaaguaaugaggguuguccaugauaucgucaaagccugcgacggaaacuuaccagcaaaauuugcuaucgaguucgcacggagccaagacgaugaucccaaacgaaccguagcaagagccgauagauuacagaaaauuuaugcccaaaucucggaugaagucguuagucaaggaguuaaagaccaauuauccggaaugaaaucauuaaaagaucgauauuaucuuuauuuuaugcaaggugggagagaugcauacacuggaaaaccgcuaaauauugacagauuaucagauuacgacauagaccauauaaugccucaaaguuucauuaaagacgauagccuugacaaucgaguucuaguaacuagagcaguaaacaaucaaaaaucagauaaugugccgguacucuuauacgggaaucaccuaguagcggauuuaggaauuacaauuagagaaaugugggauagauggcagaaaagcggaaugauaaguaaaagaaaauuagcaaaccuacucacagauccagccacacuuucugaauaccgugccgaaggcuucauaaaccgacaacucguugaaacaucacaagugauaaaacuaacagcuacgauacuacaaucagaguucccagacaguaaaauaauagaagugccagcaaaauauaacucaauacuaagaaaacaauuugauuuauauaaaagccgcgaaguuaacgauuaccaucacgcaauagaugcguacuuaucuacaauuguugguaacuauuuauaucaaguauauccuaacuuaagacgccuauucguauauggagaauuuaagaaauucucacacggagaggaagaaagcagucaccaagccguaaggcgaguaaaaucaaugaacuucuuggacgaucuauuaagaggcaaacauggugacgauauauacugucgcguaacaggugaaguuauauuuucgcgaaaagacauaauaucaaaacuaaaacaggcuuacuccuucaagcaaaugcuugugacacaagaagucuucacaaagaaaucagcuuuauucgaccaaaccgucuaccccucuccagcacgggacuccaaaacaagaagcggacuaauaccacguaaacaaggaauggacaccgaaauauacggaggguacaguggcaauaaagaugcauacuucguacuagcacaagucguuaaauccaaaggccacacccuacaaguaguggguguuccaaucagagcccuacgugcauuagccaacuguuccaauuauucagaacaacuucuaaaaaucguaaaggcacaaguacuauucaauaagaaaacaggaaaagcaaagaaagguauaucagacguaaggauccugcucgacaaaauuccauacaggcaaccaguacucgacggcuccgccuuuuacaugcuaggaagcaguaccuacaaauauaacuugaaacaaauaucacuaagccaacaaagcaugaaauacaucuuagacuacauagacgacccaaacuucaacaaacacgagaugaccaaaauugaccaacaaaacgaaaaggaaugucuauuaaguguauacgacgaaauacucgauaaaauggauaaauaccuuucauuauacgacaucaauggauuuagaaagaaauuacacgucggacgcgauaaauuuauuaaauuagaaguagaaaaacaagcugaagcaauuaaaaauguauuaagaggauuucaugcaaauagugacaugacaaaacuuagcgaccuuggacucuccacaaguuuaggauuuaugcaagcaagugacggcauaaaacuaagcgacaaugccguauuuauauaccaaucuccaacaggccuauuugaaagacgcguaaaagucucagaucucuuaaaguga

SEQ ID NO: 9118 - RNA, 4260 nt, Artificial Sequence
  Cas9 variant
augaugaucaaaaacauauuaggacuugacuuaggaacuaauagcauaggaugggcauuaaucaagcaaaacuucgaaaacaaauauggagaaauucuaggaaugggaucuagaauuauuccuaugucacaggacguacuaggcgaauuuggcaaaggaaauagcguaucucaaacagcagcaagaacgggauaccgaggaguaaggagauuaagggaacgauucuuacuucgaagggaacgacugcacagaguacucaacgucuuaaacuuuuuacccgaacacuacgcaucacaaaucgauuucgaaaaacgguuuggaaaauuuaaauaugagacagaaccgaaauuagccuacaacaaugaugguuucuuuuucaaaaacucauucgaugagaugcucggcgacuucaaagaccaccaauuucaucuuuuagaaaauggaagaaagguaccauaugacuggacuauauacuaucugaggaaaaaggccuuaagucaaaagauagagaaagaagaauuagcuuggauacuacucaacuuuaaucagaaaagaggauacuaccaauuaagaggagaagauuucgaagaagaaaaagauagaguauuuguacggcuaaagguagauagaguaguagacaguggcgaaaacauaaaaggcaaaauacuauacgaugucuauuuugagaauggcuggaaguacgaaaaacaaauagucaagacugaagacuggaucggacgaacaaaagaguuuaucguaaccgaauccauuuuaaagaauggagauaccaaacguacauucaaagcaguagauagcgaaaaagauuggauagcaauaaagaccaaaacagaacaggaaaucgacaaaucacacaaaacaguaggagcauacauauaugaagcucuccuucaaaauccaaaacagaaaaucaaaggaaaauuaguuagaacaaucgaaagaaaauuuuacagagaagaacuaaagaaaauccuagaacgacaaaaagaguuccacccagaacuccaaagcgaugaucuauacaaugacuguauacgcgaauuauacagaaacaacgaagcacaucaaauaacauuaucaaagaaagacuuuguccauuuauuacuaaaugacuuaaucuucuaucaaaggccgcugcgaucucagaaaaguucaguauccaauuguacauuagaauuuaggaaauacaaagacgaaaacggaguggaacaugcacaauauuuaaaaacaauaccaaaaucaaacccauacuaucaagaauuuaggguauggcaauggauguuuaaccuaaauaucuauagaaaagaugaugauacaaacguaacgaaagaguucuuaucaucaacagaagauuaugaaacacuguucgaguucuugaacaacaggaaagaaguugaucaaaaagcccuucuccgacauuucaaacuuaacgaaaagacucauagguggaacuauguagaagacaagaaauaucccuguaaugaaacaaaaaccaugaucucaacaagacuagaaaaaguagaaaauuauccaucagacuuuuugacacgagaaauggaacaaaacauauggcacauaauauacagcguuaaugauaaaauagaauacgaaaaagcccucaaaaguuucgcccauaaaaauaaccucgaugaaaauuccuucuucgaagcauucaagaaauuucccccauuuaaauccgaauacggaaguuucagcgaaaaagcgauuaagaaacuauuaccccuucuacgccuaggaaaauacuggaacugggaauccauagauagaaaaucucaaggaagaaucgaaaagauuauuaccggagaguucgacgguaacauuaaagacaaaguacgagaaaaagcaauacaccuaacagcggaaaacgacuuccaaggacuacaacuauggcuagcacaauacauagucuacggacggcacucagaagcaucaaugauaggaaaauggaacagcgccgacgaccuagaagaguucuugaaaggauucaaacaacacucucuacgcaaccccauagucgagcaagucauaacugaaacguuaagagugguaaaagauaucuggcuaaaauacggaaauggugcaaaagauuucuuuagcgaaauacacauagaguuaggacgcgaaaugaaacaaaccaaagaugaacggguugaugccacuaaacgaauuacagaaaacgaaaauacaaaucuuagaaucaaagcacuuuuagcagaaaugaugaacgauaauagcguagagaauauaagaccauauagcccaaugcaacaagaaaucuuaaaaauauaugaagaugguauacuaaaaagugauaucgaaaucgacgacgauauacugaaaaucucaaaaacugcacaaccaucaucuucugaccuaaaacgcuauaagcuaugguuagaacaacgauacaaaaguccguacaccggacaaauaauuccacugaauaaauuauuuacaagcgaauacgaaauagaacacauaauuccacaaucacguuacuucgaugacagcuucaguaacaaaauaauaugcgaaagugcugucaacaagcuaaaagauaauuacauaggacucgguuuuaucaaacaauucggugggaugauaguagaauguggcuucgggaaauccgucgaaauauuuaaagcugaagaauacgaagacuuuguaaagaaacauuacgcaaauaaccgcucaaaacgcaauaaacuacuacuagaagaaauuccagagaaaaugauugaccgacaauugaaugauaccagacauauuaguaaauauauuaguggcguuuugagcaacauaguuagacaagaagauggaaccgacgaaggagugaacagcaaaaacauuguaccuggaaaugguaagaucaccacacaauuaaaacaagacuggggguuaaacgacguauggaacgaauuaauacuaccacguuucgaaagaaugaaccaacuuacaaacucaacagacuucacaagcuggaauaaaaaucaucaaaaauucuugccgacagugcccaucgaauuuucaaaaggguucaguaaaaagaggauagaucauagacaccacgcuauggacgcacuugucauagcuugugcaacaaaagaucauauaaauuuacuaaacaaccaauccgcaaaaagugauacaaaaagauacgacuuaaaaagaaaacuaaugaaauucgaaagaguuguauacucccacaguaaaacaggagagaaaauugaaaaagaaguacccaaacaauucuuaaaaccgugggacaacuucacaguagaugcuaaaaacaaaauggagacaauaauagucucuuucaaacaaaauuuaagagucauaaauaaagcaacaaaccacuaugaaaaauggaucgaaaaagauggcauaaagagaaaagaacucaucaaacaagaaggaacaaacugggcaauacgaaaaccaaugcacaaagaaacagucuccgguaaaguagaccuacccggaauaaaaaucccaaaggggaaaauauuaaccgccacucgaaaaagccuagacaccuccuucgaccuuaaaaccaucaauaguauaacagacacuggaauacaaaagauucuaaagaauuauuuagaauuuaaaggaucgucagaauuggcauucucaccagagggaaucgaagacaugaauaaaaauaucgaaaaauuuaaugacgggaaaccacaucaaucaauaaacaaagucagaauauuugaacuagggaguaaauucucaguaggacaaacaggaaauaagaaagacaaauacguagaggcagccaaaggaacaaaccuauuuuucgcaguguacgaggacaaaaauggcaaacgaaguuacgaaacaaucccuuugaacgagguuauugaaagacaaaaacaaggacuugauucgguaucguuuaaaaauaaagaggauuuccugcuaugcccuaacgauuuaguauacguuccgagugaagacgaauuagagaacaucuauaacauugauuuuaaaaacuuaacaacagagaaaacggggaauaucuauaaaguuguuagcuuuaguggaaaucaaauauucuuuaucagacaagacauagcaauaaguauaguaaauaaagcugaauuuucaacgcucaacaaaauggaaagagcgauagauggcucaaugauaaaagaaaauuguauuaaacuaaaaauugaccgacuaggaaacauagcaaaaauuuga

SEQ ID NO: 9119 - RNA, 4263 nt, Artificial Sequence
  Cas9 variant
auggcaaaacccaaggacuauacuauaggauuagauauaggaacuaauucaguuggaugggucguaacugacgaccaaaacaacauucuaagaauaaaaggaaagaaagcaauuggugcgagauuauucacggaaggaaaaguggcugcagaacgaagaaguuucaggaccacuagacguagguuaucaagaagaagauggagaauaaaaauguuagaagaauuauucgacgaagaaaucgcuaaaguagaucccaguuucuucgcgagacuucaugagagcuggauaucccccaaagacaaaagaaaacgguacucugcgauaguauucccguccccugaagaagacaagaaauuucacgaaucguacccaaccauauaccaucugagagacaaacuuaugaaagacgaucaaaaacaugacauacgagaaauauacauugcaguacaccagaugauuaaagcucguggcaacuuucuucacgaugagagcguugagacauaccgcucaggcaugaguaguuuaggagggagaucagagagaacaauauugucagugcaaacgcucgaagaauuaaaugaucuauuugcugaaaacgaaggcaccgaagaagucgaauuaaacguagcauccgccgagcagauaaacgauauuuugacaggaggacauuuaaaugccgauucgcaaaaagaaauauccaauuuauugcuacccaguucauucccgucuuuugacgauaaagcaaaagaaaaacaaguaaagaaacuaauaaauaauguggcaacaaauaucagcaaagcguggcucggcuauaaagcugacuucaguaccauacuaaaucuugcaaaaguagacaaagaucagaagaaaauauucgcauucgcucuacaaggagaagaugaagaagacaaaguucaagaauuagaaucacuauuagaacaaucucaaacagacaucguagaccgguuaauugaaauaaggcaugcaauaguucugagugaaauaguuccaguaggaaugacccuaagcgaagcaaugaucgacaaauacgaccaacauaaagaagaccuaauaacacuuaaagcaguaauaaggaacacaaaagauaaaaagaaagcagcaaaacuucaagcaauuuaugacuuauaugugaaaaacagacaugcagacuuagcaaaagcgaugaaacugacuggaaucaagaaacgcucugaacuauuagaccccgaagaacugaagaaaggcauuaguucuuuacuagaugauucuccugaagcgguagaaaucaaacaacguuuagaagagaaaacauuccucccacuacaacgaucaaauaacaacggaguaauaccuaaccaauuacaucaaguagaacuagaugaaauaauaaagaaacaaagcaaauacuacccuuuucuugcagagaaaaacccagacgaaucugaagaagcacaaaagaaagcccccacaaaacuagaugcacuacuuaccuuuagaguaccuuauuacgucggaccaaugaucacuaaagaagaacaagaagcacaaaauggccauucauuugccuggaugguacgaagggauccacaagaccacgaagcaaucacacccuggaauuucgagaagaaaguggacaaaauggcuucagcuacacaauucauaaaacgaaugacuacuaaagauacauaucuuuuaggagaagauguacuacccgcaucaucacucaaauaccaacuauucacugugcuuaacgaauuaaauaauuuacgcguaaacgggaagaaauuaacaagcgacgaaaaagaacaagucauugaaggacuauucaagaaacagaaaacaguaaaagcugacaaauucguaaaauacuggcaagcaaaacauauuggcgcugauauuaaaguuaaaggccuuucagacccaucaaaauucaacucaacaaugucaacauauauugacuucaagaaaauuuucggugaucaguuaaaugauguaaacagacagaaugacuucgagaaaaucauagaauauuccaccauauucgaagauagaaaaauauuagaagauaaacuaagagcagauuucgcguggcucagcgaagaacaaaucaaacaacuuugcagacuuagacuacaaggauggggacguuuaucagacaaacuucuaacaagacuuacugaugccgacggccagaacguauuagagcgacuauggaauaguaacgacaauuuuguacaaauuguaagugauccaaacauaaaagcaaaaaucgaacaagagaaucaaaaacuacuaagggauagucaaagcgacaacgcgguugaaaguaucuuagacgaugcauacacaucuccacaaaauaagaaagccaucagacagguaaugaggguaguacaugauauaguaaaagcaugugacggaaacguacccgcaaaauuugcgauugaauuugcaaggucgcaagaagacgauccaaaacgaacgacagcucgaguaaaccaaaugcagaaaauuuacgaccaaaucucagaugaggucgugucacaaggaguuaaagaacaacuaucaggaaugaaaucgcuuaaagaccgguauuaucuauauuucaugcaagguggccgugacgcauacacaggggcuaaacuuaacauugacagguuaagugacuaugacguagaccauaucaugccacaaaguuuugucaaagacgauucacuagacaauagaguccuaguugcacgugcagugaacaaucagaaaagcgacaaaguacccgcacuacuauuuggcaauaaaguagucgccgaucucgguauaaccgucagagaaaugugggacaaauggcaaaaauuagggaugauuaguaaaagaaaacuaucaaaucuacuaacugauccggacgcacugacugaauacagagcucaaggauuuauuagaagacaauuaguugaaacaucacaagucauuaaauuaacugcaacgauacuccaaagcgaguuuccagauuccaaaauaauagaaguaccggcaaaauacaacaguaucguaagaaaacaauuugaucuauauaaaagcagggaaguuaacgacuuccaccaugcaauagaugcauauuuaucuacaauagucggaaacuaccuauaccaagucuauccaaacuugcgucgaauguuuguguauggagaguucaagaaauucagcucaaacgcggaagaaucagcccaugaugucgcuagacgaguaaaaucuaugaauuucuuagaugaucuucuaagaggaacacacggagauaacauauauugucgcucaacaggagaaauaguauucaacagaaaugacauaauaaguaaacucaaacaggcuuauuccuuuaaacaaaugcuggucacgcaagaaguauucacaagaaaaucagcuuuauucgaucaaacaguauaccccagcccugagagagauaguaagaaacgcaguggauuaauaccgcgaaagaaaggaauggacccggaaauuuauggaggauacgcccacaaccaagacucauacuucguacuagcuaaaauagagaaaguaaaaggauacacucugcaaauuguaggaguaccaauccgaucacuugaaauuauaaacaaagcagaagauuucuccacagcuuuguuggacauuauaaaaucaaaaguaauguacaaugagaaaacuggucaaccuaaaagagguaucaaaaacguagaaauacuuguaaauaaauuacccuauagacaaccaauauuagaaaaagacguaucauacauguuaggaucuuccgcauauaaguauaacaugaaacaaauuacacugagcaggcaaucuaugaaauauauuuuagauuacauugacgaucccaauuuuacaaagcacgaaaugacaaugaucgacgaacaaaaugaacgagaaugucuccuaucaguauacgacgaaaucuuagaaaaaguagauaaauaccuaccgcuauucgacggcaacaaguuuagggaaaaauuacacagcgcaaggaaggaguucguaagucuaucuguugacgacgaagccucugcaauugagaaaauauuacgaggucuucacgcuaauagugaaaugccaucacuagaaaaccuaaaaaucaaaccugcucuuggguuuuuccaaaugaaaaacggaauuacacuaagcaacgaugcaguacuauuauaucaaaguccaaccggccuguuugaaagacgaguaaaaguaucugaucuacuuaaauga

SEQ ID NO: 9120 - RNA, 4263 nt, Artificial Sequence
  Cas9 variant
auggccaaaccaaaagacuacacuauaggacuggauaucgguaccaauuccguaggauggguaguuacagaugaccaaaacaacaucuuaagaaucaaagguaagaaagccauaggagcacggcuguuuacagaaggcaaagucgcagccaaaaggagaaguuuucguaccacacguagacggcugucaagaagaagauggagaaucaaacuauuagaggaacucuuugacgaagaaauugcaaaaguagauccaucauuuuucgcgagauugcacgagucauggaucagcccaaaagacaaacgaaagagauauucagccauaguauuuccuagcccugaggaagauaagaaauuucaugaaucauauccaacuauauaucaccuaagggauaaacuaaugaaagacgaucaaaaacacgauaucagagaaauuuauauagcaguacaucaaaugaucaaagcucggggcaacuuccuacacgaugaaagcguagagacauaucguucagggaugucuucgcucggaggucgcucggagagaacaauauuaagcguacaaacccuagaagaacuaaaugaccuauucgcagaaaacgaaggaacagaggaaguagaacucaaugucgcaucugccgaacaaauaaaugauauauuaacagguggacaccuuaaugcagacucacaaaaagaaauaucaaacuuauugcuuccaaguagcuuuccuucauuugacgacaaagcaaaagaaaaacaaguaaagaaauuaauuaauaacguagcgaccaauauaucaaaagccuggcuuggcuauaaagcugacuucaguacaauuuuaaaccuagcuaaagucgauaaagaucaaaagaaaaucuuugcauuugcacuacagggcgaagaugaagaagacaaaguacaagaacuagaaucccuauuagaacagucacaaacagacauaguugaccgacucauagaaauacgacaugcaauuguacuuagugaaaucguaccaguaggaaugacacuauccgaagcuaugauagacaaauaugaucaacacaaagaagaccuaauaacacugaaagcaguuauaaggaauacaaaagacaaaaagaaagcagcuaaacuacaagccauauaugaccuauacguuaaaaaucgucaugcugaucuagcuaaagcaaugaaacucacaggcaucaagaaaagaucagaacuacuagaucccgaagaacucaagaaaggaauaucaucccuauuggacgauucuccagaagcagucgaaauaaaacagagaauugaggagaaaaccuuucucccacuacaacguucaaauaacaauggcguaauaccuaaccaauugcaucaaguggaacuagaugaaauuauaaagaaacaaaguaaauacuaccccuuccuagccgagaaaaauccagacgaaucagaagaagcccaaaagaaagcaccaacaaaacuagacgcacuacuaacauucagaguaccuuacuacguggguccaaugauaacaaaagaagaacaagaagcacaaaauggacauucauuugcuuggaugguuagaagagauccacaagaccaugaagccauaacuccauggaauuuugaaaagaaaguagauaaaauggcaucggcaacgcaguuuauaaaacguaugacaacgaaagacacuuaucuucuuggagaagaugugcuacccgcgaguucucuaaaauaucaguuauuuacaguuuuaaacgaauuaaacaauuugagaguaaaugguaagaaacuaacaagcgacgaaaaagaacaagucauagaaggacuauuuaagaaacagaaaacagucaaagccgacaaauuuguaaaauauuggcaagcaaaacauauuggggcagacauaaaaguaaaaggacuuucagacccaaguaaauucaacucgacuaugucaacauacauugacuuuaagaaaauauucggagaucaacuaaacgauguaaauagacaaaaugacuucgaaaagauaauagaauauucaacaauauucgaagaucguaaaauacuagaagacaaauuacgcguggauuuugcauggcuuucugaagaacaaauaaaacaauuaugcagacuaaggcuacaaggaugggggaggcuuagcgacaaacuucuaacuagacuuaccgacgcagacggccaaaacguuuuagaaagacuauggaacuccaaugauaauuucguucaaauagucuccgaccccaauaucaaagcaaaaaucgaacaagaaaaccaaaaacucuuaagagacucucaaagcgauaacgcaguagaaucgauacuagaugaugcauacacaucaccccaaaauaagaaagccauaagacaaguuaugcguguaguucacgacauaguuaaagcaugcgacgggaacguccccgcuaaauucgcaauagaguucgcuaggagccaagaagacgauccaaaacgaacaacugccagaguaaaccaaaugcaaaagauauacgaccaaauaucagaugaaguaguaucacaaggcguaaaagaacagcuaagcggaaugaaaagucucaaagaccgguacuaccuauauuuuaugcaagggggucgagaugcauacacuggagccaaacucaauauugauagauuaagugacuaugacguggaucacauaaugccccaaaguuuuguaaaagacgauaguuuggauaauagaguucuaguagcacgagcagucaauaaccaaaaaucagauaaaguacccgcacuacuauuuggaaacaaagugguagcugaucuaggaauaacuguaagagaaaugugggauaaguggcaaaaauuaggaaugaucucaaaaagaaagcuaucaaaccuccuaacagauccagacgcauuaacagaauauagagcacaagguuucauaagaagacagcuaguagaaacuucacaaguaauuaaacuuacagccacaauauuacaaucugaguuccccgacaguaaaauaaucgaaguaccggcgaaauacaauaguauuguaagaaagcaauucgaucuguauaaaucacgugaagucaacgacuuucaccacgcgauugacgcguaccucucaacaauagucggaaacuacuuauaccaaguauacccaaaucuccggagaauguuuguguauggugaauuuaaaaaguuuucaucaaaugccgaagaauccgcucacgauguugcacgacgaguuaagaguaugaacuuccuagacgauuuacuacgaggaacacauggcgauaacauauauuguagaagcaccggugaaauugucuuuaacagaaacgacauaauuucaaaauuaaaacaagccuacagcuucaagcaaaugcuagugacacaagaaguauucacaaagaaaucugcauuauucaaucaaacaguuuacccuuccccaaaaagggaugggucaaaacgaucgggacugauaccaagaaaacgcggcauggauccagaaauauauggaggauaugcucauaaccaagacucccacuuuguauuggcaaaaauagaaaaaguuaaaggauacaccuugcaaauaguaggugugcccauacgaucauuagaaauuauaaauaaggcugaagauuucucaaccgcacuacuagacaucauuaagagcaagguaauguauaaugagaaaacaggacagccuaaaagaggaauuaaaaacguagaaauauuaguaaauaaacuacccuacagacaacccauauuagaaaaagauguaagcuacaugcuaggaagcucugcauauaaauacaauauaaaacagauuacacuaucgaggcaauccaugaaauacauauuagacuacaucgacgauccgaacuucacuaaacaugaaaugacaaugaucgaugaacaaaaugaacgagaaugucuauuauccguuuacgaugaaauacucgaaaaaguagauaaauaccuaccccuauuugacggaaauaaguuccgcgaaaaacuacauagugcucguaaagaauuuguaucgcuaaguguagaugacgaagccagugcgauagagaaaauauuaagaggauuacaugccaacucggaaaugccaucguuggaaaaucuaaaaauaaaaccagcauuggguuucuuccaaaugaaaaauggcauuacauuaucuaaugacgcuguacuacuauaccaaagcccaacaggacuuuuugaaagaagaguaaaaguaucagauuuauuaaaauga

SEQ ID NO: 9121 - RNA, 4263 nt, Artificial Sequence
  Cas9 variant
auggccaaauucaauaaaaauuacucaaucggacuagauauuggcguauccuccguuggauacgcuguaguuaccgacgauuaucgagugccagcauuuaaauuuaaaguauugggaaacacagaaaaagagaaaaucaagaaaaaccuaaucgggagcaccaccuuuguaccagcucaaucagcccaagguacucgagucuuuagaguuaacaggagaagaauugauaggagaaaucaccgaauagcuuacuuacgagauauuuuccaaaaagaaauagaaaaaguagauaaaaauuucuacagacgccucgacgaaaguuuuagaguguuaggggauaaaucagaagaauuacaaauuaaacaaccauucuuuggagacaaagaacuagaaaccgcuuaucauaagaaauacccaacaauauaccaucuccguaaacaccuagcugaugcagauaagaacucucccguagcagacauacgagagguauacauggcaauaucacauaucuuaaaguaucguggacauuuccucacauuagauagaauaaacccaaauaacaucaauaugcaaaacaguuggauugauuuuauagaaucaugucaagagguauucgacuuagaaauaagcgacgaauccaaaacuaucgucgcaauauuuaaaucuucagacaauagacaagaaaaaguaaagaaaauccuaucauauuuccaacaagagcuccuuaagaaagacaaaucaauauucaaacaacugcuucaauuacuauucggacuaaaaacaaaauuuaaagacuguuucgaauuggaggaagaaccagacuuaaacuucaguaaagaaaauuaugacgaaaaucuagaaaacuucuugggaucucuagaagaagauuuuagcgacgucuucgcgaaauuaaaaguauuacgugacacuauacuacuuucgggcaugcuaacauacacaggaacaacccgggccagauucucagcaaccauggucgaaagauacgaagaacacagaaaagaccuacaaagguucaaaaguuucguaaaacaaaaucucucugaacaagacuaucucgacaucuuuggacgaaaaaccccuaacggcuucgacguagauaaagaaacgaaaggcuacguaggauauauaucaaauaaaauggucuuaaccaauccgcaaaagcaaaagacaauacaacaaaauuuuuaugacuacaucaguggaaaaauaacaggaauagaaggugcagaauauuucuuaaacaaaauuagcgacggcacguuccuccguaaacugcgaaccacagacaacggcgcagucccaaaccaaauacacgccuacgaacuagagaaaauaauugauagacaaggcgaggacuauccauucuuacucgaaaauaaagacaaacugcuaagcauauuaacguuuaaaauaccauauuacguaggaccacucucaaaaggaaacaacucacgauuugguuggauaaaaagaaccaucucccaagauauacuugacgauaaugaugaagacaccagaaaugggaaaauccgaccguggaacuaccaaaaguuaauaaauauggacgaaacaagagacgccuucaucaccaaucucauuggaaacgauauaauccuuuuaaacgaaaaaguacuaccaaaaagaucccuaauauacgaagaagucaugcuacaaaaugaacuaaccagggucaaauacaaagauaaauaugguaaaacgcauuucuucgauuccgaauuaagacaagaaauaauaaacaaucucuucaaaaccaauaauaaaaggguuucuuccgcaaugcuacuugauuaucuugaaaacuauacaaaccuccaagcaguagaaauaguaucaggaauugagaaaggaaaaucuuugaacucuacgcucaaaacauauaaugaccuaaaaacaauauuuuccgaagaauuauuagacagcgaaauuuaucaaaaagaacuagaagaaauaguaaaaguuauuaccguuuuugaugauaagaaaucaaucaaaaacuauuuaauaaaauauuucggccauuuggaguuccucaaugaagaaagaauaaaccaacucucuaaacuccgcuacacagguuggggcagauauagcgcgaaacuacuccuggacauacgagacgaagauaccgguuuuaaccugaugcaauuuuuacgcaaugaugaugaaaacagaaaucuaucacaauuaaucucggacuccacacuaucauucgauucagcaauaaaaucgauucaaucaaaauccacaguagaagaugauguauucgacgagauaaagaaauuagcagguucccccgccauaaaacgagguauucucaauucaaucaaaaucguagacgaacuuguccaaauaauaggauacccaccccaaaacauaguaauagaaauggccagagaaaacaugacaaccgaagaaggacaaaagaaagccaaaacccgcaaaacaaaauuagaaagcgcacuuaaaaacauagaaaacucaguuuuagaaaaugggaaagugccucacuccgaugaacaauuacaauccgaaaaauuguaccucuauuaucuucaaaacggaaaagacauguauucacuagacaaaaccgguucucccacacccuuauaucgugaccaacuugaccaauaugaaguugaucauauaauaccauauuccuucuuaccgaucgacucaaucgacaauaaagucuuaacacauagagaaaauaaucaaagaaaacucaacaacauaccagauaaagaaacaguagcaaacaugaaaccuuuuugggaaaaacucuauaaugcaaaacucauaucccaaacaaaauaccaacgacuaaccacaagcgaaagaacaccagacggaguucucacagaaagcaugaaagcuggauuuauagaacgacaauuaguugaaacgagacaaauaauuaaacauguugcucgaauacucgacaacagauuuuuggauaccaaaauaauagccuuaaagagccaauuaaucacaaacuuuagaaauacauuucauaucgcaaaaauaagagaacuaaaugacuaucaccaugcccaugaugcuuaccuugcagucguaguuggacaaacacuacuuaaggccuaucccaaacuggcaccagaguuaauauauggacaucacgcacauuucaaccgacaugaggaaaacaaagcaaccauacguaaacacuuauauucaaauauaaugagauuuuucaacaacccagacucaaagguaagcaaagauauuugggauugcaaccgggaccucccuauuaucaaagaagucauauacaacucacaaguaaauuuuguaaaacgaacuaugauaaagaaaggagcauucuacaaccaaaacccugucggaaaauucaauaaacaaauugcagcgaacaauagauacccuuuaaaaaccaaagucuccucuuuagacacuucgauauacgguggauaugguccuaugaacucugcucucucaauaauaauaaucgccgagagauucaaugagaagaaagggaaaauagaaaccguaaaagaauuucacgacauauucaucauagauuauaagaaauucaacaauaauccguuucaauuccuaaaugacaccucagaaaaugguuucuuaaagaaaaacaauauaaacagaguauuagccuucuacggagucccaaaauauucauuaaugcagaaaaacgauggaacacguaugcuguucgaaucaaaaucuaaucugcauaaagccacacaauuuaaauuaacaaaaacgcaaaacgaacuauucuuccacaugcgacgcuuacuaacaaaaucaaauuugauggaccuaaaaucagaaucagcaauaaaagaaucucaaaacuucauuuuaaaacauaaagaagaguucgauaacauaaguaaucaacuaucggcuuuuucacagaaaaugcuaggugacacaacgucucuaagaaacuuaaucaaaggauacaacgaaagaaaaaucaaagaaauagauucaagcgaagaaguuauaaaauacuuuuacgauaauuuuauaaaaauguuuagcuucgucaaaagcggcgcgcccaaaggaauaaaugacuuuuucaacaacaaguacaccgucgcucgaaugagaccaaaaccagauaagaaauuucucaaugccacucuaauucaccaaucaauuaccggucuauaugaaacuagaauugaucuaagcaaauuaggcgaagauuga

SEQ ID NO: 9122 - RNA, 4263 nt, Artificial Sequence
  Cas9 variant
auggccaaauuuaauaagaacuacucaauaggacucgauauuggagucaguagcguaggauacgcaguaguuacagacgauuauagagucccagcguucaaauuuaaaguucuaggaaacacugaaaaagaaaaaauaaaaaaaaaccuuauaggaucaacgacuuuuguaccggcacaauccgcucaaggaaccagagucuuucgagugaacaggagaagaauagaccgccgaaaccaucgcauugccuaccuccgugacauuuuucaaaaagaaauagaaaaaguggauaaaaacuuuuauagacggcucgacgaaucauucagaguauuaggagauaaauccgaagaauuacaaaucaaacagccauucuucggagacaaagaacuagaaacugccuaccauaaaaaauacccuaccauauaucaccuucgaaaacaccucgcagaugcagacaaaaacagccccguagcagacauacgugaaguauacauggcaaucucacauauacuaaaauacagaggacauuuccucacauuagaucgaauuaauccaaacaacauaaacaugcaaaacaguuggauagacuuuaucgaaaguugccaagaaguguuugauuuagaaaucucagaugaaucaaaaacaauaguagcgauauuuaaauccuccgauaacagacaagaaaaaguaaaaaaaauauuaucauacuuucaacaagaacuacuaaaaaaagacaaaucaaucuucaaacaauuacuucaacucuuauuuggacuaaagacaaaauucaaagacuguuuugagcuagaagaagaacccgaccuuaacuuuucgaaggaaaacuacgacgaaaaccuggaaaauuuucuaggaucgcuugaagaagauuucucggauguauuugcuaaauuaaaaguacucagagauacaauauuacucuccggaaugcuuacauacacaggaacaacccgagcaagauucucagcuacuaugguagagagauacgaagaacauagaaaagacuugcaacgauuuaaaucuuucgucaaacaaaaccuaucugaacaagacuaucucgacauuuuugguagaaaaacccccaacggauuugauguagacaaagaaaccaaaggguacguagguuacauuagcaacaaaaugguccucacgaauccucaaaaacaaaaaacuauacaacaaaacuuuuacgauuacauauccggaaaaauuacagggauagaaggagccgaauacuuccuuaauaaaauuuccgacggaacauuucuaaggaaauugcggacaacagauaacggggcuguaccaaaccagauacacgcguaugaacucgaaaaaauaauagaucgacaaggagaagacuauccguuccuacuagaaaacaaagauaaacuacucucaauacucacauucaaaauccccuauuacguagggccccuaucaaaagguaacaacuccagauuuggguggauaaaacggacgauaucacaagauauacucgaugacaacgacgaggacacacgaaauggaaaaaucaggccauggaauuaccaaaaauuaaucaacauggacgagacacgcgacgccuuuaucacaaaccucauaggaaaugacauaauauugcuaaaugaaaaagugcugcccaaaagaucgcuaauauacgaagaagucaugcuccaaaaugaacuaacacgagucaaauacaaggacaaauauggaaaaacacacuuuuuugacagcgagcuaagacaagaaauaauaaauaaccuauuuaaaacuaauaauaaacgaguaucuucagcaaugcuacucgacuacuuggaaaacuacacuaaccuacaagcagucgaaauaguaucaggaauugaaaaaggaaaaucacuuaauagcacccuuaaaacauacaacgauuuaaaaacaauauuuucagaagaacuucuugacucagaaauauaccaaaaagaauuagaagaaauaguuaaaguaaucacaguauucgaugauaaaaaauccauaaaaaauuaucuaaucaaauacuuuggccacuuggaguuucuuaaugaagagagaauaaaucaauugucaaaacuacgauacacagguuggggccguuacuccgccaaacuacuacucgauauccgagaugaagauacaggguuuaauuugaugcaauucuuaagaaaugacgacgaaaaucgcaaucuuucacagcuaaucucagauagcacguuauccuucgacagugcaauaaaaaccauucaaucuaaaaguacgguagaagacgacgucuucgaugagauaaaaaaacucgcuggaagcccggccauuaaacgaggaauacuaaauucaauaaaaauuguagacgaauuaguucaaauaauaggcuacccgccacagaauauugucauugaaauggcaagagaaaauaugacuaccgaggaaggacaaaaaaaagcaaaaacaagaaaaacaaaacuugaaucugcacuaaaaaacauagaaaauagcguacucgaaaacggcaaagucccacauagugacgaacaacuacaauccgaaaaacuauaucuauauuauuuacaaaacgguaaagacauguauagccuagauaaaacuggguccccaacuccauuauauagagaucaauuagaccaauacgaaguagaccauauuauacccuacuccuuccugccaauagacucaaucgacaauaaaguguuaacacauagggagaauaaccaacgaaaauuaaacaauauaccagauaaagaaaccguagcaaauaugaaaccauucugggaaaaacucuacaacgcaaaacuuauaagucaaacuaaauaccaaagacuaaccacaucagaaagaacccccgacggcguauuaacugaaaguaugaaagccggcuuuaucgagaggcaacuaguagaaacccgucaaauaaucaaacaugucgcccgaauccuagauaauagauucuuagauacuaaaauaaucgcacugaaaucacaacuaauaaccaacuucaggaauacuuuccauauagcaaaaauaagagaacuaaaugauuaccaccacgcccacgaugccuauuuagccgugguaguaggacaaacauuacucaaagcauauccaaaguuagcccccgaacucauuuauggccaccaugcccacuucaauagacacgaagaaaauaaagcuacaauccgcaaacaccuauauagcaacauaaugagauucuucaauaauccagacucaaaaguaucaaaagacauaugggauuguaaucgcgaccuacccauaauaaaagaagucaucuauaauagucaaguaaauuucgucaaaagaacaaugauuaaaaagggugccuucuauaaccaaaaucccguaggaaaauuuaacaagcaaaucgcagcaaacaacagauacccacuaaaaacaaaaguuagcucauuagauaccucaauauauggagguuauggaccaaugaacucagcacuaucaauaauuauaauagcagaaagauuuaaugaaaaaaaaggaaaaaucgaaaccgucaaagaauuucaugauauuuucaucaucgacuacaaaaaauuuaauaacaacccauuucaguuccuuaaugauacaucagaaaauggguuucuuaaaaaaaauaauauaaacagagucuuagccuucuacggaguccccaaauauagucuuaugcagaaaaaugacggcacacgaaugcuguucgaaagcaagucaaaccuacacaaagcaacacaauuuaaacuaacaaaaacccaaaacgaacucuucuuccauaugagacguuuauugacgaaaagcaaccucauggauuuaaaaucagaauccgcaauaaaagaaucccaaaacuuuaucuuaaagcauaaagaggaauuugacaacaucucaaaccaacucuccgcuuucagccagaaaaugcuaggggauaccaccagucuacgaaauuuaaucaaaggcuacaaugagaggaaaauaaaagaaauagacagcuccgaagaaguaauaaaauacuuuuaugacaacuucauaaaaauguucagcuuugucaaaagcggcgcuccaaaagauauaaacgauuuuuuuaacaacaaauacacaguggcaagaaugagaccaaagccggauaaaaaguuuuuaaacgccacgcuuauucaccaaaguaucacaggccucuaugaaacucguauagaccuauccaaauuaggcgaagauuga

SEQ ID NO: 9123 - RNA, 4263 nt, Artificial Sequence
  Cas9 variant
auggcaaaauucaacaaaaauuacucaauaggccuugacaucggaguaucgagcguaggcuaugcaguagucacagacgacuaucguguuccggcuuucaaauuuaaaguccuaggaaacacugaaaaagagaaaauaaagaaaaaccuaauuggcucaacgaccuucguuccagcacaaagcgcacaaggaacacgagucuuccgagucaaucgacgacggauagacagacgcaaucaucgaauagcuuaucuuagagacauauuccaaaaagaaaucgaaaaaguugacaaaaauuucuaccgacgacucgacgaaucauuuagaguacuuggugacaaaagcgaagaacuccaaaucaaacaacccuucuucggcgacaaagaacuggaaaccgccuaucauaagaaauacccaacaauuuaccacuuaagaaaacaucuagcugaugccgauaaaaauagcccaguagccgacauacgagaagucuacauggcuauaucucacauuuuaaaauauagaggacacuuuuuaacucuagaccggaucaaccccaauaacauaaacaugcaaaauagcuggauugacuucauagaaucuugucaagaaguguucgaccuagaaauaucagacgaaucaaaaacuauaguagcaaucuucaaaaguagcgacaauagacaagaaaaaguaaagaaaauauuaucuuacuuucaacaagaacuacuaaagaaagacaaaucuauauucaaacaacuacuucaauuacuauucgguuuaaaaacaaaauucaaagauuguuucgaacuagaagaagaaccagaccucaauuuuuccaaagaaaauuacgacgaaaauuuagaaaacuucuuaggcucucuugaagaagacuuuuccgaugucuucgccaaacuaaaaguucuacgagacacaauccuuuuaucuggaaugcucacguacaccggcacuaccagagcgagauucucagccaccaugguagaaagguacgaagaacaucgaaaagaccuccaaagguuuaaaucauucguaaaacaaaaccuaagcgaacaagacuauuuagacaucuucggaagaaaaacaccuaacgguuucgauguugacaaagaaaccaaaggcuacgucggauacauaagcaacaaaaugguccucacaaacccacagaaacagaaaacuauacaacaaaauuuuuaugauuacauauccgggaaaauaacaggaauagagggcgccgaauauuucuuaaacaaaauaucagacgggaccuuccuaagaaaauuacgcaccaccgacaacggggcaguuccuaaccaaauacaugcauaugaacucgagaaaauaauagaccgacaaggcgaagacuacccuuuccuuuuagaaaauaaagacaaacuacuuucgauccuaacauucaaaaucccuuacuauguaggcccccuuuccaaaggaaauaacucaagauuuggauggaucaaaagaacuauaagccaagacauacuugaugauaaugacgaagauaccagaaauggaaaaauacggccauggaacuaucaaaaacugauaaacauggaugaaacuagagacgccuucauaacaaauuuaauuggcaacgauauaauacuuuuaaacgaaaaaguacugccaaaaagaucacucauuuacgaagagguaauguuacaaaacgaauuaacaaggguuaaauauaaagacaaauacggaaaaacucacuuuuucgacucugaauuacgccaagagauuauuaauaaccuauuuaaaacaaacaauaaaagaguuuccucugcaauguuauuggacuaccuugaaaacuacaccaaucuucaagcagucgaaauaguauccgguaucgaaaaaggaaaaucucuaaacaguacauuaaaaacuuauaacgaccuuaaaacaaucuucucugaagaacucuuagauagcgaaauauaccaaaaagagcuugaagaaauaguaaaagucauaacgguauucgaugauaagaaaucaaucaaaaacuaucuaaucaaauacuuuggccaucucgaguuccuaaacgaagaaagaauaaaccaacuuucaaaauuaagguauacuggaugggguagauauucagcuaaauuacuccuugacauucgcgacgaagauaccggauucaacuugaugcaauucuugagaaacgaugacgaaaaccggaacuuaagccaacuaaucucggacaguacccucuccuuugauagcgcaauuaaauccauccaaaguaaaaguacaguagaagaugacguuuucgacgaaauuaagaaacuugcaggaucaccggcuauaaaaaggggaaucuuaaacagcauaaaaauaguagaugagcuaguccaaaucauaggauacccaccacagaacauaguaauagaaauggcacgagaaaauaugacgacugaagaaggacagaagaaagcaaaaacacggaaaacaaaauuagaauccgcccuuaaaaacauagaaaacuccguucuugaaaacggaaaaguuccacauucagaugaacaacuacaaagcgaaaaacuauaccuauauuacuuacaaaacgguaaagacauguacucccuagacaaaacagguagccccacuccuuuauaccgugaucaauuagaccaauacgaaguagaucauaucauuccauacucauucuugccaauagauaguauugacaacaaagugcugacacauagagaaaauaaucagcguaaauugaacaacauaccagauaaagaaacaguggcaaacaugaaaccauucugggaaaaacucuauaacgcaaaacugauaagccaaacaaaauaccaaagacuaacuacaucagaacguacaccagaugguguuuugacggaauccaugaaagcaggauucauugaaagacaacucgucgaaacuagacaaauaauuaaacacguagcacguauacuagacaaccgauuucuugacacuaaaaucaucgcauuaaaaucccaauuaauaacaaacuuuagaaauacauuccauauagcuaaaauacgagaauuaaacgacuaucaucaugcgcaugacgccuaccuagcagucguaguaggucaaacacucuuaaaagcauaccccaaacucgccccagaacucauuuauggccaucacgcgcauuuuaacagacaugaagaaaauaaagcaacuauccgaaaacaucuguacucaaauauaaugcgauucuuuaauaacccagauucaaaaguuucgaaagacauaugggacuguaaccgagaccuuccuaucauuaaagaaguaaucuauaauucccaaguuaacuuuguuaaaagaacaaugauaaagaaaggagcauucuauaaccaaaauccagucggcaaauucaacaaacaaauagcagcaaacaaucguuacccucuaaaaaccaaaguuucaagucuagacaccagcauauacggagguuacggaccaaugaacucagcauuaagcauaaucaucaucgcagaaagauucaaugagaagaaaggaaaaauagaaacagucaaagaauuucaugauauauucauaaucgauuacaagaaauuuaacaauaacccauuccaauuccuuaaugauacuuccgaaaacggcuucuugaagaaaaauaauauaaauagaguacucgcauuuuacgguguuccaaaauauagucucaugcagaaaaaugauggcacacguaugcuuuuugaauccaaaucuaaccuacacaaagcaacccaauuuaaacugacaaaaacgcaaaacgaauuguucuuccacaugcgacgccuacuaacaaaaucaaaucucauggaccuaaaaucagaaucagcuauaaaagaaagccaaaauuucauauuaaaacacaaagaagaguucgacaauaucucaaaucaacugagcgcauuuagccagaaaauguuaggugacacaacuucauuaagaaaucuaauaaaaggcuauaacgaacguaaaauaaaagaaauagacagcucugaagaagucaucaaauacuuuuaugacaacuucaucaaaauguucagcuuugucaaaucaggagcccccaaagauauaaaugacuucuucaauaauaaauauacgguagcacgcaugagaccaaaaccugacaagaaauucuuaaacgcuacauuaauacaucaaagcauuaccggcuuauaugaaaccagaaucgauuuaaguaaacucggcgaagauuga

SEQ ID NO: 9124 - RNA, 4263 nt, Artificial Sequence
  Cas9 variant
auggcaaaauuuaacaaaaacuacaguauaggacuagacauaggaguuagcuccguagguuacgcaguaguaacagaagauuaucgcguaccugcauuuaaauucaaaguacucggaaauacugaaaaagagaaaauaaagaaaaaucugauagguucaacaacuuuuguaccagcacaauccgcucaagguacaagaguauuuagagucaauagaagacgcauagaccggagaaaucaucggauagcguaccucagagauaucuuucaaaaagaaauagagaaaauagauaaaaacuucuauagaagacucgacgaauccuuccguguacugggugacaaaucugaagauauucaaauaaaacaaccuuucuuuggcaauaaagaacucgaaaccgcuuaucacaagaaauacccuacaauauaucaucuaagaaaacacuuagcugacgccgacaaaaacaguccuguagccgauauucgggaaguuuacaugguuuuaucacacauccucaaauacagaggucacuuuuuaacacuaggaaaaaucgaucccaauaacaucaacaugcaaaacucuuggauagacuuuauagaauccugucaagaugcuuuugaccuagaaaucucagaugaaucaaaaacaaucgcugccauuuucaaaaguucagaaaaccgucaagaaaaaguuaaacaaauuuuauccuacuuucaacaagaacuucucaagaaagacaaaucaauuuucaaacaacucuuacaauuguuguucggcuuaaaaaccaaauuuaaagauuguuucgaguuagaagaagaaccagaccuaaauuuuucuaaagaaaauuacgacgaaaauuuagaaaaccuacuaggugcccucgaagaagauuucucagacguauucgcaaaacugaaaaucuuaagagacaccauuuuacucucaagcaugcuaaccuauacuggcgcaacccaugcacgauuuuccgcaaccaugguugagagauacgaagaacauagaaaggacuuacaacguuuuaaaucauuugucaaacagaacuuauccgaacaagauuaucuugacauuuuuggacgcaagacaccaacgggauucgacguagauaaagagaccaaaggauacguagguuauaucaguaauaaaaugguauuaacaaauccccaaaaacaaaagacaauccaacaaaauuuuuacgacuauauaucaggcaaaauaaccgguauagaaggcgcagaaugcuuuuuaaauaaaaucagugaugguaccuuuuuacguaaacuccguacaacagacaacggugcuaucccaaaccaaauacaugcauaugaacucgagaaaauaaucgaaagacaaggacgggacuacccauuucuacuagaaaauaaagauaaauuacucucaauacugacauucaaaauuccuuacuauguuggcccacuugcaaagggcaauaacagcagauuugcauggaucaaacgaacaacaucucaagacguacuagacgacaacgaugaagacacacguaaugguaaaaucagaccuuggaacuaucauaaacucauaaauauggaugaaacuagagacgccuuuauaauaaaucuuauagguaacgacauaauucuacuaaacgaaaaaguccucccaaaacgauccuuaauauacgaagaaguuaugcuccaaaaugaacuaacuaggguaaaauauaaagacaaguacggaaagauacacuucuuuaauucugaacuacgccaagaaauaauuaauaaccuauuuaaaaccaacucaaaacgaguaucaucagcaauguuacucucauaccuagaaaacuuuaccaaccuacaagcaguagaaauaguaucaggcauagaaaaaggaaagagcuugaauagcacacucaaaaccuauaacgauuuaaaaacaauuuuuagugaagaacuacuugauucggaaauauaccaaaaagaacuagaggaaaucauaaaagucaucacuguauuugaugacaagaaaagcauuaaaaacuacuuaacaaaauacuuuggacaccuugaguucuuaaaugaagagaaaauaaaccaauuaagcaaauugagauauacaggauggggcagauacucggguaaauuauuacucgguauacgcgaugaagauacgggauucaaucuuaugcaauuccuuagaaacgaugaugaaaaccgcaaucuaacacaauuaauaucugauaccacucuuagcuucgauucagcaauaaaagccauacaaucaaagucuacuguugaagaugacguauucgaagaaauuaaaaaccuagcuggaucgccugcuauaaaaaggggcauacuuaacucaauaaaaauaguggacgaauuaguucaaauuauugguuauccaccacaaaacauaauuaucgaaauggcucgagaaaacaugacaaccgaagaaggccaaaagaaagcaaaaacaaggaaaaguaaauuagaaucagcguuaaagaauauagaagacagcguauuagaauccggcaaagucccccacuccgaugaacaacuccaaucagaaaaacuauaccuauauuacuuacaaaaugguaaagauauguauucacuagacaaaacagguucucccaccccacuauauagagaucaacuugaccaauacgaaguagaccauaucaucccguauuccuuccuaccaauagacucuauugacaauaaaguacucacacauagagaaaacaaucaacgaaaacucaacaauauaccagacaaagaaacaguugcaaauaugaaaccuuucugggaaaaacuguacaaugcaaaacuaauaucacaaacaaaauaucaacgccugacaacaagugaacgaacaccugacggcguucuaacagaaagcaugaaagcaggauucauagaacgacaauuaguagagacccgacaaauuaucaaacacguagccagaauacuagacaaucguuuuucugauaccaaaaucauuacacuaaaaagucagcuaguuaccaacuucagaaacacauuucacauagccaagauacgugaacucaacgauuaccaucaugcccaugacgccuaucucgcaguuguaguaggacaaacacuuuugaaagccuaccccaaacucgccccugaacuaauauacggacaccacgcacauuucaacagacaugaagaaaacaaagcaacauuaagaaaacacuuauacuccaacauaaugagauucuucaacaacccggauucuaaaguuaguaaagauauaugggauuguaacagagacuuacccauagucaaagauguuaucuacaacucccaaauaaauuuugucaagcguacaaugauaaagaaaggcgcauucuacaaccaaaauccugucggcaaauuaaacaaacaaauagcagcaaacaaucgauacccacuuaaaacaaaaguuaguucacuagauaccucuauauaugguggcuacggaccaaugaacucagcacucagcaucaucauaauagcagaacgcuucaaugaaaagaaaggaaaaauagagacagugaaagaguuccacgauauauuuauaaucgacuaugaaaaauucaauaacaauccauuccaauuccuaaacaacguauccgaagaaggauuccuuaagaaaaacgacuuaaacagaguucuugccuuuuaucgaauaucuaaauacucccuaaugcagaaaauagacggaacucgcaugcuauucgaaucaaaaucaaaccuucacaaagugacacaauuuaaacuaacaaaaacccaaaaugaauuguuuuuccauaugaaaagacuucuuaccaaaucuaaccuaauggaucucaaauccgagucugccauaaaagaaagucaaaacuuuauacaaacacaccaaaacgaguucgacaacauagcagacagacuuaguaacuacucacagaaaaugcuuggagagaccaaaucauuacaaacuuuaauaaacggguauaacgagcgaccaauaaaacaaauagauaauaaugaagaaacaauccgcuacuacuaugauaauuuuauaaaaauguuuucauucguaaaaaguggcgcaccaaaagacaucaucaauuucuucaacgacaaauacaccgugccacgaaugagaccaaaaccagaucgaaaaaugcucgacgccacucucauacaccaaucuauaacaggacucuaugaaacacgaauugaccucucaaaacuuggcgaagauuga

SEQ ID NO: 9125 - RNA, 4263 nt, Artificial Sequence
  Cas9 variant
augucaaggaaaaauuacguugacgauuaugcaauaucguuagauauaggaaaugcaagcguaggaugguccgccuucacaccaaauuaucgauuaguaagagcaaaaggucaugaauuaauaggggugcgcuuauuugauccagccgacacagccgaaucuagaagaauggcacgaacaacacguaggcgauauucaagacgaagauggcgauuaagacucuuagacgccuuauuugaucaagcauuaucagaaauugauccaaguuuccuggcaagaagaaaauauaguuggguacauccagaugacgaaaacaaugcugauugcugguaugguagcguccuauucgauaguaacgaacaagauaaacgauucuaugaaaaauacccaacaauuuaucauuuacgaaaagcacucauggaagaugacucacagcacgacauuagagagaucuaucuagcaauacaucacaugguaaaauacagaggaaacuuucuagucgaaggaacuuuagaaaguucaaaugcuuucaaagaagaugaacuccuaaaauuacuaggacguauaacaagauaugaaaugagcgaaggggaacaaaauagcgacauagaacaggaugaugagaauaaauuaguugcgccggcuaauggacaacuagccgaugcacuaugugcaacacgagguucuagaaguaugagaguggacaacgcacuggaagccuuaucagcgguaaaugaccuuucgcgagaacaaagagcaauaguaaaagcaaucuuugcaggguuagaaggaaauaaacuagaucuggcuaaaauuuuuguuagcaaagaauuuagcuccgagaacaagaaaauauuaggcauauauuuuaauaaaucugauuacgaagaaaaauguguucaaauaguagauuccgguuuauuagacgacgaagaaagagaguuucuugauaggaugcaaggucaauauaacgcaaucgcacucaaacaauuauuaggacgaagcacaucuguaucagauucaaaaugcgcaaguuaugaugcgcaccgcgcaaauuggaaucucauaaaacuacaacugagaacuaaagaaaaugaaaaggauauuaacgaaaauuaugggauucuaguaggauggaaaauagauaguggacaaaggaaaaguguacggggugagagcgccuacgaaaauaugcguaaaaaggccaauguauucuuuaagaaaaugauagaaacuucggaucucucagagacagacaaaaacagacuuauacaugauauagaagaagacaaauuguuuccaauccaaagagauagcgauaacggaguaauaccacaccaauugcaucaaaaugaacuuaaacagauaaucaagaaacaaggaaaguacuauccuuuucuauuagaugcauucgaaaaagaugguaaacaaauaaauaaaauagaaggacuacuaacauucagaguaccguacuucguaggaccguuggucguaccagaagacuuacaaaaaucugauaacucagaaaaucacuggaugguaagaaagaagaaaggcgaaauaacaccauggaauuuugaugaaaugguagacaaagacgcuucggggagaaaauucauagaaaggcuuguaggaacagauucauaucucuuaggggaaccuacguuaccuaaaaauucacuauuguaucaagaguaugaaguacuaaacgaauuaaacaacguacgauuaucaguuagaacagggaaucauuggaacgacaaaagaagaaugcgacuggggagagaagagaaaacacucuuaugucaaagauuauucaugaaaggacaaacagucacaaaaagaacagccgaaaauuuacuuagaaaagaauauggaaggaccuaugaauuaucaggauuaucggaugaaagcaaauuuacuucaucauuaagcacuuacggaaagaugugcagaauauucggggaaaaauacgucaaugaacacagagaucuaauggagaaaauuguagagcuucaaacgguauuugaagacaaagaaacuuuauuacaucaacugaggcaguuagagggaauaagugaagcggauugugcccuccuaguaaauacccacuauacagggugggggaggcuaagccguaaguuauugacaacgaaagcuggugaaugcaaaauauccgaugacuuugcgccaagaaagcauucaauaauagaaauaaugagggccgaagaucgaaaccuuauggagauuauuacagauaagcaguuaggguucucagauuggauagaacaagaaaauuuaggugcugaaaacggcuccucauuaauggaaguugucgacgaucuaagaguuucaccaaaaguaaaacgugggaucauccaaucuauaagacuaauugaugauaucagcaaagcgguagguaaaaggccaucaagaauuuuccuggaguuggcagacgauauacagccaaguggacguacaaucucaagaaaaagcagacuacaagacuuauaucguaaugcuaacuuaggaaaagaauuuaaagggauagcggacgagcuaaacgcauguagcgauaaagaucuucaagacgaucgacuauucuuauauuacacccaacuaggaaaagacauguauacgggagaagaauuagaucuagauaggcuaaguagugcuuacgauauagaccauauaauuccucaagcgguuacacaaaaugacucaauagauaauagaguguuaguugcacgagcagagaaugccagaaaaacagauucauucacauacaugccucaaauagccgauagaaugagaaacuucuggcagauuuuauuggauaauggucuaauaaguagaguaaaauuugaaagacucaccagacaaaaugaauuuucagaacgugaaaaagaaagauucguucaaagaucacucgucgaaacaagacaaauaaugaaaaaugucgcaacccuaaugaggcagagauauggaaauagcgcagcggucauaggacuaaaugccgaacuaacaaaagaaaugcaucgguauuuagguuucucucacaaaaauagagacauaaaugacuaucaucaugcacaagacgccuuaugcguaggaauagcgggccaauucgcagcaaaccguggauucuucgccgacggcgaaguuagugacggagcccagaacaguuauaaucaauacuuacgagauuauuuacgagguuauagggagaaauuaagugcagaagacagaaaacaagggcgagcauucggguuuauaguagguagcaugcgaagucaggaugaacagaaaagggugaauccgcguacaggcgaaguagucuggagcgaagaagacaaagacuaucugaggaaagucaugaauuacagaaaaauguuaguaacccaaaaagucggugaugauuuuggagcauuauaugaugaaacaagauaugcagcgaccgauccuaaaggaaucaaaggaauaccauuugauggagccaagcaagauacaagucuauacggggguuuuagcuccgcuaaaccugcguacgcaguacuuaucgagagcaaaggaaaaacaagauugguaaacguaacgaugcaagaauacagucugcuaggagaucgcccuagugaugacgaauuaagaaagguauuagcuaaaaagaaaagugaauaugcaaaagcuaauauacugcuuagacacguucccaagaugcaauuaaucagauacggaggaggacuaaugguuauaaaaagugcaggagaauuaaacaaugcacaacaauuauggcugccauaugaagaauacugcuauuuugaugauuugucgcaaggaaaagguagcuuagagaaagaugaccuaaagaaauuauuagauaguauuuugggaaguguccagugcuuauacccuuggcacagguucacagaagaagaauuagcagacuugcauguagcauuugacaaauuaccagaagaugaaaagaaaaauguaauaacaggaaucguaucggcacuacaugcagacgcaaaaacagccaauuuaagcauugugggaaugacaggaagcuggagaagaaugaacaauaaaaguggauauacauuuuccgaugaagacgaguucauauuccagagcccaagcggauuauucgaaaaacgaguaacuguuggagaacuaaaaaggaaagcgaagaaagaaguaaauuccaaauauagaacaaacgagaaaagacuuccaacucuaagcggagcaucucagccauga

SEQ ID NO: 9126 - RNA, 4263 nt, Artificial Sequence
  Cas9 variant
auggcaaaacccaaagauuacaccauagguuuggauaucggcaccaauucaguuggauggguuguaacagaugaucaaaacaacauuuuaagaauuaaaggaaaaaaagcaauuggcgcaagauuauucgcugagggaaaaguugcagccgagagaagaucauuucgcacaaccagaagaagaauuagccgucgacguuggagaauaaagcuacuagaagaauuauucgaugaagagauugcaaaaguagaucccagcuuuuucgcacguuuacacgaaucauggauaagcccaaaagacaaacgaaagagauacucagcaauugucuuucccucaccagaagaagauaaaaaauuccacgaaucuuauccaacuauauaucaccuccgagacaaauuaaugaaagaugaucaaaaacaugauauaagagaaaucuauauagcgguccaucaaaugauuaaaguacgagguaacuuuuuacaugacgaaucaguagaaacauacagauccggaaugucaucauuggggggcagaucagagcggacaauauuaucaguccaaacccuagaagaacucaaugaucuuuuugccgaaaaugaagguacagaagagguagaauuaaacguagcgucagcagaacagauaaacgacauuuuaacuggagaccaccuaaacgcugauucacaaaaagaaaucaguaaccucuuguuacccucgucauuuccaucauuugacgacaaggcaaaagaaaaacaaguaaaaaaauugauuaacaauguagcaacgaacauaucaaaagcauggcuuggguauaaggcagauuucucuacaauacuaaaucuugccaagguggacaaagaucaaaagaaaaucuuugcauuugcucuucaaggaggagaugaagaagacaaaguccaggaacuugaaucacucuuagaacagucacaaacagacauaguagaccgauuaauagaaauacggcaugccauagugcuuagugaaaucguaccggugggcaugacuuuaucagaagccaugauagauaaauacgaccagcauaaagaagacuuaauuacucuaaaagccguaauaagaaauacaaaagacaaaaaaaaagcagccaaacuccaagcaauuuaugaccuauacguuaacaacagacacgccgauuuggcaaaagcaaugaaacuaacagggauaaaaaaacgaucagaacugcuagauccagaagaacucaaaaaagcaauuagcaguuuacucgaugauucuccagaagcaggcgagauaaaacaacgcuuggaagguaaaacuuuuuuaccucuucaacgaagcaauaauaacgggguaauaccaaaccaauuacaccaaguagaguuagaugaaauuauaaaaaagcaaagcaaauacuacccauuuuuagccgaaaaaaauccagaugaguccgaagaagcccaaaaaaaagccccgaccaagcuagaugcauuacucacauucagaguacccuacuacguagguccaaugauuacuaaagaagagcaagaagcucaagacggccacuccuucgccuggaugguaagaagagauccacaagaccaugaagccauaacaccguggaacuucgaaaagaaaguugacaaaauggcgagcgcuacucaauuuauaaagagaaugacaacaaaagacacuuauuuguuaggcgaagauguauugccugcaaguagucucaaauaccaacuauuuaccguccucaacgaacuuaauaaucuaagaguuaauggcaaaaaauuaacgucagaugagaaagaacaaguaauagagggacuauucaaaaaacaaaaaacaguaaaagcagauaaauucguuaaauacuggcaagcaauacauauaggagcagauauuaaaguaaaaggcuuauccgauccaucuaaauuuaauucaacaaugucaacauacauagacuucaaaaagaucuucggagaccaacuaaacgacgcaaaucgccagaacgauuuugaaaaaaucauugaauauagcacaauauuugaagauagaaaaauacuugaagacaaacuccgugcagauuucgcauggcuuagcgaagaacagauaaaacaacuaugucgacugcgauugcaaggguggggaagauuaagcgauaaauuacugacuagacuaaccgaugcagauggacaaaacguccucgaacguuuauggaauucgaacgauaacuucguacaaauaguuucagacccaaauauaaaagcaaaaauagaacaagaaaaccaaaaacuguuaagagauggucaaagcgacgaugcaguggaaucuauauuagacgaugcuuauacaucuccacaaaacaagaaagcaauaaggcagguuaugaggguaguacacgacaucguuaaagcuugcgauggaaaugucccagcuaaauuugcaauagaauucgcacgaagucaagaagaugacccaaaaagaacaaccgcucggguaaaucaaaugcaaaaaaucuaugaccaaaucuccgaugaaguaguaucgcaaggaguaaaagagcaauuaucagguaugaaaucacuaaaagauagauacuacuuauauuucaugcagggcggaagagacgccuacacgggagcaaaacuaaacauagauagauuaucagauuaugauaucgaccauauaaugccacaaaguuuuguaaaagacgauagcuuagauaauagaguacuaguagcccgagcuguaaacaaccagaaaagcgauaaaguacccgcuuucuuauuuggaaauaaaguaguagcagaccuaggaauaacaguacgagagaugugggacaaauggcagaagcuuggaaugauuucaaaaagaaaacuaucgaacuugcuaacagauccagacgcccuuacagaauaccgcgcacaaggcuucauucguagacaauuaguugaaacaucccaagucauaaaauuaacagcaaccauacuucaauccgaauucccggacucaaaaauaaucgaaguucccgcaaaauauaacuccaucguaaggaaacaauuugauuuauauaaauccagagagguaaaugacuuccaucaugcuauagacgcauauuuaucaaccauaguaggaaauuauuuguaucaaguauauccaaaucuacgaaggauguucguauauggagaauuuaaaaaauucagcuccaacgccgaagagagcgcucaugauauggccagacgaguaaaaaguaugaauuuucucgaugaccuacuacguggcacacacggagauaacauauacugcagaucaacaggagaaauaguguucaaccgaaaugauauaauuucaaaauuaaaacaagcuuauagcuucaaacaaaugcucguuacacaagaaguauuuacaagaaaaucagcauuauucgaccaaacuguauacccguccccagaacgagacaguaaaaaacgaagcggacugauaccuagaaaaaaagguauggacacagaaauauauggugguuacucuggaaacaaagacgcuuacuuuguacuugcggaagcuguaaaagaaaaaggccauacccuacaaauaguagggguccccauaagagcguuaaauacacuuaaaaacucagcaaauuauagugaaaaacuccuagagauaaucaaaccacaagucauguuuaauaagaaaaauggaaaaccaaaaaaaggaguaaaugacguuagaauuuuaauggauaauauaccuuaccggcaacccguacuagaagguggugcucuguauaugcucgguucauccacauacaaauacucacuaaaacaaauuacucuaucacaagagucuaugaaauauaucuuagauuauaucgacgaucccucauucaauaaacacauaauggucaauauagaucaccaagacgaaaaaaaauguuuguuauccguauaugacgaaauucuugacaaaauggacaaauaccugccgcuauucgauaucaacggcuuuagaaaaaaacuccacgacggucgagaaaaauuuguaaagcuuccaguagaaaagcaagcagaaguaguaaaagauaucuuaagaggauugcaugcaaacucagaaaugacgaagccuuccgaucuuggucuaacaaccgcacuagguuucaugcaagcuccugacggcauuaagauuuccgacgaugcaguauuuauuuaucaguccccaacaggacuauucgaacgacgagucaaaguaagcgauuuauuaaaauga

SEQ ID NO: 9127 - RNA, 4266 nt, Artificial Sequence
  Cas9 variant
augaccaaauucaacaaaaacuauuccauagguuuagauauaggggucagcucuguaggauaugcgguaguuacugaagacuauagaguccccgcauucaaauucaaaguauuaggcaacacagaaaaagagaaaauaaagaaaaaccuuauagguucaacuacauucguuucagcacaacccgcaaaaggcaccagaguuuuucguguaaaccgacgaagaauugacagacgaaaucacagaauaaccuaucuacgcgauaucuuucaaaaagaaauagaaaaaguagauaaaaacuuuuacagacgauuagaugaaucuuucagaguacuuggagauaaaucugaagaccuccaaauaaaacaaccauucuucggcgacaaagaacuugaaacugcauaccacaagaaauauccaacaauauaccaccuaagaaaacaccuagccgacgcagauaaaaauucacccguagcagacauacgugaaguauauauggccauuucacacauauuaaaauaucgaggacauuucuuaacucuagauaaaauaaauccaaauaauauaaauaugcaaaacaguuggauugacuuuauugaauccugccaagaagucuuugacuuagaaauuagugacgaaucgaaaaauaucgcugauaucuucaaauccucagaaaaucgacaagaaaaaguaaagaaaauacuaccauauuuccaacaagaacuccucaagaaagacaaaucaauauuuaaacaacuucuacaauuacucuuuggacucaaaaccaaauuuaaagacugcuuugaacuagaggaggagcccgaccucaacuucucaaaagagaacuaugacgaaaauuuagagaacuuucuagguucauuagaagaagacuucagcgauguguuugcuaaacuaaaaguauuacgagacacaauccuccucagcggaaugcuaacguacacaggagcgacgcacgcuagauuuucugccacaaugguugaaagguacgaagaacaccggaaagaccuacaacgauuuaaauucuuuaucaaacaaaaccucucugaacaagauuaucuagauauauuuggccgaaaaacccaaaauggauucgacguagacaaagaaaccaaaggcuaugucggcuacauaacaaacaaaauggugcuuacgaacccgcaaaaacagaaaacuauacaacagaauuucuaugauuauaucaguggaaaaaucacaggaauagaaggagcagaauauuuucucaauaaaaucagcgacggaacauuucuaagaaaauuaagaacaucagauaacggugcaauaccuaaccaaauacacgcauaugaguuagagaaaauaauagaaagacaaggaaaagauuacccguuuuuauuagaaaacaaagauaaacuccuauccauccuuaccuuuaaaauaccuuacuacgucggaccccucgcaaaagguucgaacucgagguucgccuggauaaaaagagcgacaucaagcgacauacucgacgacaaugacgaagacacuagaaacggcaaaauucgaccauggaacuaccaaaaacuaauuaacauggaugaaaccagagaugcuuuuauuacgaaucuuauaggaaacgacauuauacugcucaacgaaaaaguauugccaaaacgcucucuaauauaugaagaaguuaugcuccagaaugaauuaacgcgaguaaaauacaaagauaaauacggaaaagcucauuucuuugacucagaacuuagacaaaacauuauaaauggacuauuuaaaaacaacuccaaaagagucaacgccaaaucccuaauaaaauaucucuccgauaaucauaaagauuuaaacgcuauugaaaucguaucaggaguagaaaaaggcaaaaguuuuaacucaacgcuaaaaaccuacaacgaucuaaaaacaauauuuagcgaagaauugcucgauucagaaauauaucaaaaggaacucgaagaaauaauaaaaguuauaacaguauucgaugacaagaaaucuaucaaaaauuaucucaccaaauuuuucggucaucucgagauacuugaugaagagaaaauaaaccagcuuucuaaacuacgauauagcggcuggggaagauauucagccaaacuauugcuagacauccgagaugaagacaccgguuuuaauuuguuacaauuccuaagaaaugaugaagaaaaucggaaccucacuaaauugauuucagacaacacauuaaguuucgaaccaaaaauaaaagacauacaaagcaaaucaacaauagaagaugauaucuuugaugaaaucaagaaauuagcagguucgccggcaauaaaacgcggcauacuaaauucaauaaaaauaguggaugaauuaguacaaauaauaggauauccaccccauaacauaguaaucgaaauggcccgggaaaacaugaccaccgaagaaggacaaaagaaagcaaaaaccagaaaaaccaaacuagaaagcgcgcucaaaaacaucgaaaacucacuacuagaaaacggaaaagucccccauagugacgaacaacuacaaagugaaaaauuauaucuauacuaucuacaaaauggaaaagacauguauacauuagacaaaacaggaaguccugcaccccuauaucuagaucaacucgaucaguaugaaguagaucauauaauucccuacucuuuccuaccaauagacucuauugauaacaaaguacuuacccacagagaaaacaaucaacaaaaauuaaacaacauuccugacaaagaaacgguugcaaacaugaaaccauucugggaaaaacuauacaacgcaaaauuaauaucacaaacaaaauaucaacggcucacuacaagcgagaggacccccgauggaguacucacggaaucaaugaaagccggauucauagaaagacaacucguagaaacaagacaaauuauaaaacacguagcaagaauuuuagacaaccgcuuuuccgauacaaaaauaauaacacuuaagucacaacucauaacaaacuuuagaaacacauuucacauagcaaaaauacgagaacuaaaugauuaccaccacgcacaugacgcauaccuagccguuguuguuggccaaacgcugcuaaaaguauauccuaaauuggccccagaacucauauauggacaccaugcccauuucaacagacacgaggagaauaaagcaacgcucagaaaacauuuauauagcaacaucaugcgguuuuucaauaauccagauuccaaagucuccaaagacauaugggauuguaaccgagaccuacccauaauaaaggacguaauuuacaacucacaaauaaacuuuguaaaaagaacaaugaucaagaaaggagcuuucuacaaccaaaacccugucggaaaauuuaauaaacaacuagccgcaaacaacagauacccucuuaaaacaaaagcacuaugcuuagauacaucaaucuacggagguuacgggccuaugaacucagcucuaucaauaauuauaauugccgaaagauuuaaugaaaagaaagguaaaauugaaacugucaaagaauuucacgauauauucaucauugacuaugaaaaauuuaacaauaauccuuuccaauuccucaacgauaccucagaaaacgguuuucuuaagaaaaauaauauaaauagaguucuaggguucuaccggauaccaaaauacucacuuaugcagaaaauagaugguacacgaaugcuauucgaaucaaaaucuaauuuacauaaagccacccaguuuaaacucacuaaaacacaaaaugaauuauucuuccacaugaaacgacuucuaacuaaauccaaucuaauggacuugaaaucaaaaucagcaauaaaagaaagucaaaacuucauacucaaacacaaagaagaauuugauaacauuagcaaucaacugucugcauuuucucagaaaaugcuagggaacacaacaucacuaaagaauuuaauuaaaggguauaacgaaagaaaaauaaaagaaauagauauaagagaugaaacaaucaaauacuucuacgacaacuuuauaaaaauguucaguuuugucaaaagcggcgcuccaaaagacauaaacgacuucuucgacaacaaaugcacaguagcuagaaugagaccaaaacccgacaagaaauuauuaaacgcuacauuaauccaccaaucaaucacaggacuauacgaaaccagaaucgauuuaucgaaauuaggggaagacuga

SEQ ID NO: 9128 - RNA, 4266 nt, Artificial Sequence
  Cas9 variant
augaagaaaauauuaggacuagacuuaggaccaaauaguauaggaugggcccuaguaaacgaagcggaaaacgagaacgagaaaaguaguauaauaaaaaucggaucgagaguaauccauuauggugacaaccuuguaaaaguagauaaaucuggaaaaauuucagcgagcaugaccccagaagaggauuuuagcagcggaaagggacucucuccaaacgcaggcagaacuaaacaaagaucagcccgaagaaauuuacaaagauacaaacaaagacgaaacaaucucauagaaauacuaaaagcucauagccucauagauaacaauuuuauauucagugaagaaggaaacgagacuacauuuaaaaccuauaaaaaccgcgcauuagcagccacuaacgaaaucagcuuggaagauuuuauaaagguucuauuuaugauaaacaagaaacgaggauauaaaagcucacguaaagcuaaaggagacgaagauggccaauugauagacggaauggcaauagcuauacaauuauaugagcacaaccaaacaccaggacaauucguauauaaucucuugaaaaacggaaagaaaaacauaccagauuuuuaccgcucagauuuacagacagaauuugauagaauauggaacuuccaaaaagcauuccaucaagagagcuuaucggacggcauaugugaaaagcuaguaggacagaagaaaaauguaaccuccgcaauacuuuuuaaagaguucaaaauagagucauuagaaauaaaaggaaaaugggaugagaaaagguucuuccgguaugaacuacgcaauaaagccguacagcaagaauuaaaauuaaaugaaauugcagaaugucuagucgaaaucaauggcgaaauuaguaauucuagcggauaucuuggagccauaagugaucgaucgaaagagcuaguauuccagaaaauaaccgucggucaauauuuauacaaacaaauagcagccaacccgaacaccagucuuaagaaacagauauuuuacagacaagauuaccuagaugaguucaacacacuaugggaaacacaagccaaauaccacaaagaauuaaccgacgaacucaaaacacaaauaagagauguuauuauauucuaccagagaagauuaaaaucgcaaaaaggacuaauaucauucugcgaauuugaaaguaaacaaauagaaguauuuguggacggcaagaaaucuaucaaaaccagagguaugaggguaauaccuaaauccucaccacuauuucaagaauuuaaaauauggcaaauucuaaauaacaucgagauuacagaucucaaaacaaaagagagcagagaacuaaccgacgacgaacgccaacuauuauucgaagaauuaaauauaagaccaaagauaaguaagaaagaagcauuaaaaauacuaacagaaaaaccugcacaauacgaccuaaacuauaaagacauugaagguaauaaaacaaacgcaaaauucuacgaggcauauaauaagauaauacaccuaagcggacacgacgaaauugauuucacugauaaaacaucagauaucaaugaauauuuaaaacaaauauuuucccugcuaggaauaaaaccagaaauccuugauuucgacuccagccuaaaagaugaggauuucgaaaaacaacuacacuuucaauuauggcaccuccuauauagcuucgaaggagacaacaccaaaacaggagaugaaaaauuauuacagaaauuaaauacuaaauuugguuucccugucgaguacgcaaaagucauaucaaacauagcacuucccgacgacuauggcucgcuaucugcgaaagcuauaagaaagaucuuaccucaccuaaaagacggauucuccuacggaggaagaaaaaguagaccagacgaaccaucugccugugaguaugcaggcuauagacauucuaaagcaaguuuaacgaaagaugaaaaagaaaacaaaacguauaaagauaaacucgaaauccucccuaaaaauagccuaagaaacccaauaguagagaaaauacucaaucaaacaauuaacgugguaaaugcuguaaucggagauuauggaaaaccagacgaaauaagacuagaauuagcacgagaauuaaagaaaucagccgaagaacgacaagacgccacggacucgauaucaaaagccaccgcaaaacaugaaaaauaccgcaaagugcuacaaacggaauuugggcuaaaacacauuaguagaaacgauuuaauacgcuacaaauuauacuuagaacucaaaaauaaugguuucaaaacauuauauagcgacacauacauagccccauaugagaucuucuccaagaaauucgauauagaacauauacuacccaaagcgaaacuauucgacgauagcuucucgaacaagacacuagagcuaaaaucaguaaaccuaaagaaaggggauaugacagcauacgacuuuguaaaagaggaauacggaaccgagggccucgcaaaauacgaacaacgcguacaagaccuauuucuaaacaagaaacguaacgaagauuuagaucaagaaaaugagucacgcauaaccgacgagaaaauaucuaaaaccaaaagagauaaauuacuaaugccugaaaacaaaaucccuacaggauuuaucgaccgagaacuaagagauucacaauauauugccaagaaagcuaaaacgaugauggaagacauauguaaagacguaguuacuaccacaggauccgugacagauagacucagagaagauuggcagcuaauagacauaaugcaagaguuaaacuggcccaaauaugcugcacuuggacugacugaagaguucacaaaugaagaaggaaauguaauaagaaaaauuaaagacuggacaaaaagaaaugaccacagacaucacgcaauggacgcaauuacgauagccuucacaaaaagaucucauauacaguaccuaaauaacuuaagugcuagauccgacaaaagcagcagcaucuauggcauagaacaaaaagaacuauaucgagacaaaaacaacaaauuaagguucgccccgccaauuccaaucaacgaauuuagagcugaagccaaaaugcagcuagaaaauaccuuaauaucaauaaaagcucaaaauaagguaguuacgaaaaauaaaaacaaaauaucagggcaaaagaaauuacaagaaacuuuaacaccaaggggccaacuccacuuagaaacaaucuaugguaaaaucaaccaauaccaaacagcagaaauaaaaguaggaggaacacuagacagcgaacucauaaacaaaguagccaauaagaaaacaagagaagcacuacuuaaccgauuagcagaguucggcaacgacccuaagaaagcauucacgguuaaaaacacaaucgacaaaaauccaauauaucuggauaaacaccaaagcuacaaaaucccugaaaaaguaaaaauaguuuggcaagaacccguauauacaauaaggaaaucgauaacuccagauuugaaacuugacaaaauaauagacccaaaaauaaaagcccuccuggaaucaagacuaaaagaauguaauggagacgcaaaacuugcauuuucaaauuuagcagaaaacccgaucuggcuaaacaaagaaaaaggcauccaaauaaaaaggguaaccauuacggguauuagcaacgcagccucacuacaugacaagaaagaccuaaauggcaaaccaauuuuagacgaaaaaggaaauaaaauuaguguagauuucguuaauacaggaaacaaucaucauguagccauauauaaagacgaaaauggaaaccuacaugacaacguaguuacuuucuucgaagccgucgaacgugucaaccagaaccuaccggucgucgacaaacucuucaaacaaaaagaaggguggcaauuuuuauucacaaugaaacagaacgaauauuucguauuccccaacgaaauuacggcauucaacccaaacgaguucgaccuacucaaccccgacaacuacuaucucaucagcccaaauuuguuucgcguacaaacaaugucuaaaguuauguauggcaauaacacucuuagagacuauaaauuccgacaccaccucgaaacuacauuacaagauauaaaagaacuaagagacauaguauuuaaacaauuuaaaagucuaucuauauucgauaaaauuguaaaagugaggauaaaucaccuaggaaaaauaguaaaaacuggagaauacuga

SEQ ID NO: 9129 - RNA, 4266 nt, Artificial Sequence
  Cas9 variant
augaaagacauuuuaggacuagaucuaggaacaaacagcauaggaugggcaguaguaaaagaagcucaaaacgauaacgaacaaagugaaauugucgaugucggaguaagagucaauccacucacuacagacgagaaaaccaacuucgaaaaagguaaaccaauaucaacgaaugcagacagaacacuuaaaagaucagcaagacggaaucuacaacgauacaaacuuagaagaaaagaauuaauagaacuacuuaaagaacaccaauuaauuucuacagacaccauucuaacagaaaacggaaaaggaacuacguuccaaacguuagaacuaagagcaaaaucagcaaaagagaaaauaucucuugaagaauuagcaagaguuuuccugacuauaaacaagaaacgcggauacaaaucauccagaaaagcuaaaaacgaagacgaaggccaacuuauugacggcauggaaauagcaaaacgucuauaugaagaaaaucucacuacaggacaauuaucccuacaacucuuaaaagaagguaagaaaucacuaccagauuauuacagaucagacuugcaguucgaacuugauaaagucuggaacuuccaaaaacaauuccacucgcauauacucacagacgaguucuaugcacaacuaaaaggaaaaggucaacgagcaacuuccgcucuauuccuagcaaaauaucaaauauauacagcagaaaacaaagguagucgagaagacaagaaauuacaagcauaccaguggcguguagaugcgcuaaguaaagaauuaacaagagaacaauuagcauuugucauaacggaaauaaauaauaaucuuaacaacucauccggguauuuaggagcaaucucugaccgcaguaaagaauuauauuucaacaacgaaacggucggcgaauaucuauggaaacaaauagccgcaaauccacauacaucucuuaaaaaccagguauucuauagacaagauuaucuugacgaguucgaacaaauauggaaaacucaaucagcauucuauccagaaauauuaaccgaaagucuaaagaaagaacucagagacgucguuauauucuaucaaaggaaacuaaaaucucagaaaagucuaguaucauuuugugaauuugaaaacaaagaaaucgaaaucaagaaagaagaugguacauccacuaagaaagucauuggccucaaagucgcaccaaaaucaucaccacucuuccaagaauuuaaaaucuggcaaaaucuaaacaacguccuaaucaggaagaaagguuccaaaacuaagaaagccgccaaaaaccaacaagcaguacuauuugaagaagagaaaacaauuagugaacucgaccuagaagcuaaacaagcucuuuucaaugaauugaaccuaaaaggaaaucucaaagcggauuacugucucgaaauucuuggauauuccccaaaagaaugggaaaugaacuacucaguccuugaaggaaaucgaacuaauaaagcacucuaugaagccuauuuaaaaaucacagaccuagaaggauaugaugccaaaaaucaucuaaaaguaaaacuuaacaaagaugaagucgaacuagacgaucuaaaaguccccgccucagaaauuaaagauaugguacaagcgaucuuuaaagaagccggaaucaauaccgacauccuccacuuuaaugcugaacuugacggaaaagauuuugaaaaucaagcaaguuaucaguuauggcauuuacuguacucauacgaaggagacgacagcaaaucgggcaaugaacuccuuuauaaauuacuggaaacuaaauucggguucaagaaagaauacgcacaaauucucgcuaacgucucauugagcgacgacuauggaagucuauccacaaaagccaugagaaaaauacauccauauauuaaagaaaauaaauucucaacagcuugugaauuggcuggauauagacacucaaaacacuccuuaacuaaagaagaaaaugacaacagaguacucagggauucauuagaaguauuaaagaaaaauagucuaagacaaccaguaguagagaaaauuuuaaaucaaaugauaaacuuaguuaacgcccuacucaagaaauauaggacagaaaauccaaacuucaaauuugacgaaauacgaauagaacucgcaagagaacuaaagaaaaacgcagaagaaagagccaacaugacagcgaacauaaauaaagcaaaaacugaacaugagaaaauuauaaaaauucucaaaaacgaauuugggcuuccgaauccaacaagaaaugauauaaucagauauagauuauacgaagaauuaaaagcgaauggauacaaagauuuauacacuaauauaaaaauaccucaagaaaaauuauuuacuaaagaaauugacauagaacacauaaucccaaaaucuagaguauuugaugacucauucuccaauaagacguuaucauuucguaaaacaaaucuggauaaaggagaacgaacggccuuugauuauauggaauccaaauuuggcgcagauaagcuagaagaguacguagcaagaguagaagauuuauacaaaaauaauauaaucucaaaagcgaaguaccaaaaacuacucaagaaagaaucagaaauaggugacggauuuguagaacgagaccuuagagaaacccaauacauagccaagaaagcaaaagaaauacuacuacagauaacgccaaacguacuaucuacaucugguggaauaacagaccgucuacgagaagacugggaucuaauaaacguaaugaaagaacuuaaucucccaaaauaucgcgcauuaggacuaacagaaauggaagaucguaaauacgggcaacaagucgaagucaucauugauuggacaaaaagaaaugaccaccgucaccaugcaauggacgcgcucacaguagccuuuacaaaacacaaucauauacaauacuuaaauuaccuaaacgccagaaagaacgaaaaacauaaagaacauagcaauaucauggggauucaacaacuagaaaccauaaaaguaacagauaaaaauggaaacgagaagagaguuuuuaaagcaccaaugccgaacuuuagacaaguuacaaaggcuuuucucgaaaacauacuaaucucacacaaggcaaagaacaaagucguaacuaaaaauaaaaauaagguagcaggaagcaauaaaguacaagaagucuuaacgccaagaggacaacugcauaaggaaaccguuuacgguaaauaucaauacuacguucaaaaagaagagaaaauagggggaaaauuugaucuagaaacaauuaagaaaguagcaaacccuuuauaccaaucucuuuuaaagaagaggcuggaggaaaauggaggcgaccccaagaaagcauuuacaggcaaaaacucacucgccaaaaacccaauuuaccucgacgacgcccaaaccgaacaacuuccagaaaaaguaaaacuuguauggcucgaaaacagcuucaguauacgaaaagacauaacacccgaaaacuucaaggaugaaaaauuaaucgacaagauacucgacgaaggcguaaagcggauacuaaaggaaagacuccaaucauucggaaaugacgccaagaaggcuuucucagacuuagagaaaaacccaauuugguuaaacaaagaaaaaggaauaacaauaaaaagagucacuauuucaggcgucgcaaacgccgaaccacuacacacaaagaaagaucaucuuggaaaagaaauccuagacaaagaaggaaaaccgauaccaguagauuucauaucaacaggcaguaaucaucauguagcaguauaucgcgacgaaaaaggaaaccuacaagaaaaaguuguaucuguguucgaagcaguaguacgagccaaucagggacuaccaauaauagauaaaaccuacaaucaacaccuagguugggaguuccuuuuuacaaugaaacaaaaugagauguucguauuuccaaaugaaucaacaggguucaauccaaaugauauagaucucuuagaccccaaaaacaaacgaaucauuagcccaaauuuauuucgcguacagaaacuagcuacuggagauuauugguuucggcaucaccuagaaacuaccguagaaaccaaaucagccacuaaagacaugacauacaaaagacuaucccuaaaucacaucaaaaauauaauaaaaguuagaaucucacaucuuggcgacaucguaucaguuggcgaauauuga

SEQ ID NO: 9130 - RNA, 4275 nt, Artificial Sequence
  Cas9 variant
augaaaagaauauuagguuuagauuugggaacgaauagcaucggaugggcauuaguaaaugaagcggaaacagacgaggaaguaucuaguauuauucgauuaggagugcgcguaaaccccuugacaguagacgaaacacaaaacuuugaaaaagggaaaaguauaacaacaaaugcagaacgaacacucaaaaggaguaugagacggaacuugcaaagauacaaacuaagaagagaugcacugguagaguucuuaaaagaacuaggauuuauaacggacgaaacuauuuuaagugaacaaggaaauagaaccacuuuugaaacauguagguuaagagcaaaagcagcugaagaagagauaucacucgaagaauugagucgaguauuacuaaugauaaacaaaaagagaggauauaagucgagccguaaaguaaagaaagaagaagauggaguacuaauagacggcauggaaauagcuaaaaagcuauacgaagaagaucuaacacccggacaacuauguucucaacucuuggaaucaggcaagaaaguacuaccagauuucuaucgaucagaucuucaagaggaacuagauaggauuuggagugugcaaaaacaauuucauccugauguauucugugacgcagcaaaagaggaaauaaaagggaaaaaccggagucaaacuugggcaauauuagcgaauuacuuugucuggaaagaagaggucgucggauggaacgaucgagaagcgaaaaaugaaaccauagaaaaagagugcaagcuaguagguuuaaaaagaacaacaaaaggauaugaauuaaagaaggaaaauuacagauggagggcacaagcauuaacagagcaacuagguuuagaagagauagcuguagugcuacaagaaauaaauggccaaauuaacgcuaguucaggauaccuaggagcgauaucagaucgaucuaaaguccuauacuucaaccaccaaacaguaggacaauaccaaauggcagaacuagacaaaaauccacaugcaucacuuagaaacaugguauucuauaggcaagacuaucuagaugaguucgaccgcaucugggaaaaacaagcagaguuccauaaggaacucacagcagaacuuaagaaggagauacgcgauaugauaauauucuaucaaagaagacuaaaaucacaaaaaggacuaauuucuuuuugugaauuugaaagauuagaaaucguuguugaaaaggacgguaagaaacaaacaaagguaauaggauguaaagucauaccaagaagccacccucuguuucaagaauuuaaaguguggcaaacacuaaacgauauaaaaguucuuggaagagaaaagaaaagaaacgcccuuucagcgucagagucacgagcgcuauauccagaagaaaaagaaauacuugcaagagaacuugccauaaaagaaaacaugaagaaagcagacgugcucaaacuauuauucgaaaacccacaagaacuagaccuuaacuucaaacaaauagaugggaaccgcacuggcuucucgcuauuuucagcuuauuccaaaaugauagaaaaauauggauaugaacccuuagacuucaagaaaccugcagacgaaauaauaggccaauuaagaacaaucuucacggaccuugguuggaauacuaacuuguuuacgauagaccuuaccaaagaaggaaaagaauuagaaaugcaacccuauuucagauuauggcaccuauuauauucauucgagggagacaauacaucuacugguaaugguaaacuuauagagaaaauaaugcaacuaugcggaguagaaaaagaauacgcaguugaauuggccucgcugagcuuccaagacgauuauggaucccuaucugcaaaagccauaaaaaggauccucccauauuuaaaagaaggaaaccucuaugacguugcgugcgaauaugcgggauacagacauucuaaaaguagucuuacaaaagaagagauagaaaauaaaguauuaaaaggaaaguuggagguacuaccaaagaacucacuacgaaacccuguagucgagaaaauucugagccagaugguaaaugugaucaacacaauaauugauacguacgguaaaccagacgaaauacgaguagaauuagccagagaacucaagaaaagcgcaaaagaacgagaagaacucaccaaagcaauagcaaaaucaacaagagagcaugaagaaauaagaaaauuacuacaagacgaguucgguaugaugaacguaagucguaacgauauaauaagauauaagcuguaugaagaauuaaaagacaacgguuacaagaccuuauauucaaaucaauauauuccaaaagagaaaauauuuucaaaggaaauagacauagaacacauaauuccucaaagcagacuauucgaugauaguuuaaguaacaaaacauuagaauauaaagcgauaaacauagaaaaaggaaauaaaacggcauacgacuucguuaaggaaaaauauggugaagaaggauuacaacaguauaucaauagaugcgaaagucuuuuuaacgacaagaaagcuaaauuaagaaaacucaaaauggaacagaaagacaucccagauggauucaucgacagagacuugagaaauacacaauacauagcaaagaaagcauuagcaaugcuaaaugaaauuugcagaagaguaguagcaaccacaggaucaaucacagaccaacuaagagaagacuggcaauuaguggauguuaugaaagaauuaaaccuaccaaaauaugaagcauuagguuucgucgaaacuuacgaagauaaagauggacguaaaauaaaaagaauaaaagacuggaccaaaaggaacgaccacagacaucacgcuauggacgcccuaacaguagcauuuacaaaagaugcguuuauacaauacuuuaacaauaagaaugcggcucaagauucaggaaauagaaaucacaccaauaucauaggaauaaaaaccagauauuucgacaaaggucgagcauuaccuccaauaccccuggaacaauuuagaaucgaagcaaaacaacaccuagaaaaacuacucguuuccaucaaagcgaaaaauaagguaguuacaguaaaugucaacaggacaaagaaaagaaagggagaaaauacuaaaauucaacaaacaccuagaggacaacuacauuuggaaaccguuuacggcucacacaaacaauacguaaccaaaauugaaaaaguaaacgcgagcuucgacgcagcaaagaucgcaaccguaaguaaacgugcauacagaaaugcauuacuuaaacguuuagagacuuuugguaacgauccgaagaaagcauucacaggcaaaaaugcacuggagaaaaauccucuuuaugcagauaaauaccaaacaauaagaguucccgaaaaaguacaaacaguggaguucgaaacaauauauaccauuagaaaaccuguagacccugcauugaacgucgauaaaguaguagauguaaaaguacgugcaauacuagaaagaagacuaaaagaauacggaggagauccuaaaaaggcauuugugaacuucugggaaaacccaauuugguuaaauaaggaaaaagguaucaguauaaaaagggucagcauaagaggaauaaacaaugcacaaucaauacacgugaagaaagacaaaaauggaaacccuaucugggacgagaacggaaaacaaauaccagucgauuuuguaaacaccgguaacaaucaucauguagccauauaucgaaaacccguauuagacaagaaaggucaaguaacauucgacgaagacggaaaucuuauguaugaacucgaugaaguaguagugccauucuucgaggcggucacaagggcgaacuuggggcuaccaauaauagauaaagacuaucgaaaaagcgaagguuggcaauuuuuauuuagcaugaaacaaaaugaguauuucguauucccaaaugagaaaacuggguucaauccuaaagaaguggaccuucuaaauccagacaacuaugccaugauaagcccaaauuuauucagaguucaaaccaugaguaaaguaauguacggcaauaaugucguacgagacuauaaauuucgacaccaucuugaaacaacaguaaaagacaugaaggaacucaaagacauugccuauaaacaauauaaaacguuaucguuuggaaacuccguuguaaaaauaagaaucaaccauaucggacagaucgucuccgugggcgaauacuga

SEQ ID NO: 9131 - RNA, 4275 nt, Artificial Sequence
  Cas9 variant
augaaaagaauccuaggacuagaucuaggaacaaauagcauaggaugggcacucgucaacgaagcagaaacagacgaagaaguuagcaguaucaucagguuaggaguuaggguaaacccccucaccguagacgagacacagaauuucgaaaaagguaaauccauaacuacaaaugcagaacgaacuuuaaaaagaaguaugagaagaaaccuacaaagauauaaacuaagacgagacgcuuuggucgaauuucuaaaagaguuggguuuuauaaccgacgagaccauacuguccgaacaaggaaacagaacaacauucgaaacaugucgccuaagagcaaaagcagcugaagaggaaaucagcuuagaagaauuaucccgaguucuccuuaugauaaauaagaaacgugguuacaaaaguaguagaaaagugaagaaagaagaagacggaguacuuauagauggcauggaaauagccaagaaauuauaugaagaagacuuaacuccaggucaguuauguagucaauuacuugaaucggggaagaaaguucuaccagacuuuuaccacucagauuuacaagaagaacuagacagaauauggucagugcaaaaacaauuccacccagacguauuuugugaugcagccaaagaggaaauaaaagggaaaaacagaucccagaccugggcaauacucgcaaauuauuucguauggaaagaagaagucgucggauggaaugaccgugaagcuaaaaaugaaacaauagaaaaagaauguaaacucguaggacuaaaaaggaccacgaaagguuaugaacuaaagaaagaaaauuauagauggcgcgcacaggcuuuaacggaacaauugggacuagaggaaauagccguaguacuacaagaaauaaauggccaaauuaaugcaaguagcggguaccuuggagcaauuuccgacagaucaaaaguacucuacuucaaccaucaaacagucggacaauaccaaauggcagaauuagauaaaaacccccacgccucgcuaagaaacaugguauuuuacagacaagauuaucucgacgaguuugacagaauaugggagaaacaagcugaguuccauaaagaacuaacugcagaauuaaagaaagaaauaagagacaugaucauauucuaucaaaggagacuaaaaucacaaaagggacuaauuuccuucugugaguucgaaagacuggaaaucguaguagagaaagauggaaagaaacaaacuaaaguuauaggaugcaaaguuauaccucgcucgcacccgcuguuccaagaguucaaaguuuggcaaacucucaaugacauaaaaguacuaggucgagaaaagaaaagaaacgcacuaagugccucagaaucaagagcacucuacccugaagaaaaagaaauacuagcaagagaacuagcgauaaaagaaaauaugaagaaagccgacguauuaaaauuauuguucgaaaacccacaagaauuggaucuaaacuuuaaacaaauagaugguaacaggacaggcuucagccuauucagcgcuuauuccaaaaugauugaaaaauacggcuacgaaccacuagacuuuaagaaaccagcggaugaaauaauaggucaacugaggaccauauuuacagaucucggauggaauacaaaucucuucacaauagaucugacaaaagaaggaaaagagcucgagaugcaaccauauuuucgccuguggcacuuacuauauucauucgagggcgacaauacaagcacagggaauggaaaguuaauagagaaaauuaugcaauuaugcgggguugaaaaagaauacgcaguagaauuagcuaguuuaaguuuccaagacgacuacggaucgcucagcgccaaagcuauaaaaagaauacuacccuacuuaaaagaaggaaacuuauacgacguggcaugugaauaugcuggauauagacauuccaaaagcucacuaacaaaggaagaaauagaaaauaaaguacuuaaaggaaaacucgaaguccuaccgaaaaacaguuuacgcaauccaguagucgagaaaauuuuaucccaaaugguaaaugugauaaacacaauaauagauacauacggaaaaccagacgaaauuagaguagaacuggcuagagaacuaaagaaaagugccaaagaaagagaagaacuaacgaaagcaauagcaaaaucaacgagggaacacgaagaaauccgaaaauuauuacaagacgaguucgguaugaugaacguuagucggaacgacauaauccgauacaaacucuacgaggaacucaaagacaaugguuacaaaacauuauauuccaaccaguauauaccuaaagagaaaaucuucuccaaagaaauagacauagaacauauuauaccucagaguagacuauuugaugauucacuaucaaacaaaaccuuagaauauaaagcuauuaauauagaaaaagguaacaaaacagccuacgacuuuguaaaagaaaaauacggggaagaagggcuccaacaguauauaaaucgaugugaaucccuauuuaaugacaagaaagcaaaauuaaggaaacucaaaauggaacaaaaagacauaccugauggguucauugauagagaucuccguaacacacaauacauagcuaaaaaggcauuagccaugcucaaugaaauauguagaaggguaguagcuacaacaggcaguauaaccgaccaauuaagagaagauuggcagcuaguggauguaaugaaagaacuaaacuuacccaaauaugaagcguuaggauuuguagaaacauaugaagacaaagacggaagaaaaauaaaacgaauaaaagauuggaccaaaagaaacgaccauagacaccaugcaauggacgcauuaacaguagcauucacuaaagacgcuuuuauacaauauuucaauaauaagaacgcagcccaagacucaggaaauagaaaccauacaaauaucauagggauuaaaacaagauacuucgacaaaggacgugcacuuccaccuauucccuuagagcaauucaggauagaagcaaaacaacacuuagaaaaacuauugguauccauaaaagcuaaaaacaaagugguaacgguuaacguuaaucgaacaaagaaaaggaaaggagagaacaccaaaauacaacaaacaccccgaggacaauuacaucuagaaacuguauauggaagccacaaacaauauguaaccaagauagagaaaguaaaugcaucuuuugacgccgcaaaaauugccacaguaucaaaacgagcuuauaggaacgcgcuguuaaaacgguuagaaacguuuggaaaugauccuaagaaagcauucacugggaaaaaugcauuggagaaaaauccacuuuaugcagacaaauaucaaaccauucgugucccggaaaaagugcaaacagucgaguuugaaaccauuuacacaauacgaaaaccaguagauccagcacuaaauguagacaaaguaguagauguaaaagucagggcaauuuuagagcgaagacucaaagaauacgggggcgacccuaaaaaggcuuuuguuaacuucugggaaaacccaauaugguuaaauaaagaaaaaggaauaaguauuaaaagaguaaguauacgaggaauaaauaaugcacaauccauacacguaaagaaagauaaaaaugggaacccaauaugggacgaaaauggcaaacaaauaccgguggauuuuguaaauacugguaauaaucaucacgucgcaauauauagaaaacccguacucgacaagaaaggacaagucacauuugacgaagacggaaaucucauguaugaauuagaugaagucguuguaccauucuucgaagcaguaacacgggcaaaccuaggauuaccaauaaucgauaaagacuacagaaaaagugaaggcuggcaauuuuuauuuucaaugaaacaaaaugaauauuuugucuuccccaaugagaaaacaggauucaacccaaaagaaguagaucuguuaaacccagacaacuaugcuaugauauccccaaauuuauuuagaguacagacaaugucuaaagucauguaugggaacaauguaguaagggacuacaaauucagacaucauuuagaaaccaccguuaaagacaugaaagaauugaaagauauagccuacaaacaauacaaaacauuaucuuuuggaaauagugucguaaaaauuagaauaaaccauauaggacaaaucgugucaguaggcgaguacuga

SEQ ID NO: 9132 - RNA, 4278 nt, Artificial Sequence
  Cas9 variant
augagacgcaacauacuaggacuggauuuaggaacaacuucgauaggauucgcuaaagucauagaagacgaagauuaccaaaauucggcgguagaauuaauaggagugagaguaaauccauuaacaaccgacgaacaaacaaauuucgaaaaaggaagaccagucaguguuaacgcagacagaacccuaaaaagaggaaugcgccgaaaucuagacagauaccaacuaagaagacaccaccuaaucgaaguauuaaaagcaaaccacauaaucaccguagacacaaaacuagcagaagacggcaaaaacacaacacacgcuaccuaugcagucagagcacuagcagcaacagcagaaauaccacuagaagcauuugcgagaguacuccuugccauuaauaagaaaagagguuacaaaucaucacgcaaagccaaaaacgaagacgaaggucaacuaauagacggaauggccguagcaaaaagacuauaugaagaaaacuuaacaccaggacaacuuucauaucuacugcuaaaagaaggaaagaaauauuuaccagacuuuuauagaagcgaccuuaacgcugaacuagauaaaguuuggagcuuucaaaaacaauuuuacccugaaauauugaccgaagaauuuaagaaacacuuggaaggaaaaggacaaagagcaacaagcgcagccuuuuggggacaauacgguuucaauacagcagaaaacaaaggaagcagggaagaaaagaaauuaaaagcauaccaauggagaucugaagcggucgaucaacaacuaacaaaagaagaaguagcauacgucauaacagaaaucaacaaugaucuuaauaaaagcucuggguauuuaggagcaauaagcgaccgaagcaaagaauuguucuuuaauaaacaaacaguuggucaauaccuguaucaacaauuaaaacaaaacccacacacgcgucuaaaaggacaagucuuuuacagacaagacuauuuagacgaauuugaaacaaucugggaaacucaggcaaaauuucaccccgaauuaacugcagcacucaaagaagaaauaagggacguuauaaucuuuuaccaaaggaaacuaaaaucacaaaaagguuugaucagcuuuugcgaguucgaaucuaaagaaauugaaguagagaaaaacggacuaaaaauaaagaaaagaauaggauuacgaguagccccuaaaucaaguccucucuuccaagaguucaaaauauggcaaguccucaacaaucuagaguucaggaacaaaucaucaaaagaaguauuugucccugauaugacugcaaaacaacaguuauuugacgaacuaaacauuaaaggaaaucuuuuagcuucagaagcaauaaaaauccuagguuacaaaacuaaagauugggaagcgaauuaccauacucuugaaggaaauagaacaaacaaaucgcucuaugaugcauaucucaaaauacuagaacucgaaggauaugacgaagaucugcuaaaacuuaguggauccgacgacauagauguaagcaaaaucgagaaaagcgcuucugaaauaaaacaaaugguacaugcaguuuuugaaguuuuaggaauaaauagcacaauccuagauuuugacgcggaagcagacggaaaagcauuugaacaacaaacagcuuauagacucuggcaucugcuauacucugccgaagaugauaacaagaaauauuuacaagaagauauauuuauauacggacacgacaacauaggccugaaaaagaaacuaugugaaagauuuggcuucagaccagaacauacaaaaauauuaguuaauguagccuucuccggcgacuacggcucauuaagcucaaaagcaaugagaaaaaucuacccuuucauaaaagaauugacuuacgauaaagcaugcagggaagcaggauaccgacacagugcauccucacuaucgaaagaagaaaucgcuacgcggccauuacaaaaacgccuaggccuauugaagaaaaacgaacuacgcagccccguuguagagaaaauuuuaaaccaaaugguuaacgugguaaacgcauuaauagacgaugaaaauaaacgaagaaaagcaaggggauuaucagacgauuuucacuucgaugaaauuagaaucgaacuugcacgagaauuaaagaaaaacgcuaaagaaagagcagaaaugacaacaaacaucaacgcagccaaacagcuacacgagaaaauaauuaaaauauuacaaacccaauucggaguaaguaacccuucgcgaaaugauaucaucagauacaaacuuuaugaagaacugaaaaauaauggauacaaagaucuguacacuaauacauauauaucaccagauauauuauucucaaaacaaauagauauagaucacauuauuccccaaaugucauuauuugacgacucauucagcaauaaaacaguaguauuuagaaaagauaaccaagacaaaggaaauaaaaccgcguaugauuauauauuaggaaaauauggagaacuagcgcuugaagaauacauaagucgaauaacaucucuauucgaguuaggcaagaaaaauaaagaagaaggcauaaauaaagcaaaauuucaaaaacuccagaaaaggcuuauagauauuggugacggguuuauagaaaaagaccucagagaaagucaguauauagccaaaaaggccaaaaauaugcuauaugccauaugccgguccguuguugcaacgucaggagaaauaacagcacgacucagagaagacugggaucuagucaauguaaugcaagaaaucaauuuaccaaaauuucgagcacugggacuaacagaaaugguagagaagaaagauggaggccaaaaagaaagaauaauugacuggacaaagaggaacgaccaccgucaucaugcuauggacgcucuaacaauagcguuuacaagacacucgcauauccaauacuuaaaucaccuuaacgcgcgaaaagacgaagcaucaaaauggcacccagucguaagcaaaaucgaagaaaaggaaacagaccuaguauacgaugaccucgguaaucguaaaagaagauucaaggcacccaugccaaacuuuagggaaguagucaaggaacacuuggagaacguuuuaauaucacacaaagccaaaaauaagguaguuaccaaaaauaaaaacaaaaucaaaacugcaaaaggagagaaaauaaaaacagaacuuacaccucgaggccaacuccauaaagaaaccauuuacggaagguauagguacuaugaaagcaaagaagaaaaaguagggccaaaauuugaugccgaaacaauaggcaugguaguaaauccacaauaccgcaaacuacuacucgagcggcuaacaacaaauggaaaugauccaaagaaagcauuuggaggcaaaaacacacuaucgaaaaauccccuauacauugacgaagcaaaacaagaauuacuaccagagaaaauacuuuuacgauggcuaaaugacgacuacagcaucagaaaagauguaacgccagaaaaccucaaagacgucaaaacgauagaaaaaguacuugacgaaggaaucaagaaaauacuacuaaaaagacuugucgacuucggaaaugaccccaagaaagcguucagcgauuuagauaaaaauccgaucugguuaaaugaagccaaaggcauuaccauuaaacgaguaacaauaaguggaguuaaaaaugcugaagcccuccacuauaagaaagaccacuucggcaaugcaauacuuaacgaaaauggaaaacugauacccucaucauucguaaguacgggcaauaaucaccauguugcaauauauagggaugcagaaggcaaccugcaagaacgcguuguauccuuauucgacgccguacagcuagucaacgcgggcgaagcaguaauagauagagaauacaacaagggaauaggauggcaauuucuauuuacuaugaaacaaaacgaaauguucguauucccaaacgaaaagacagguuucgaccccaaagaaauugaucuccuuaacacagauaaccguaaacuuauaucacccaauuuauuccgaguacagaaaauagccagcaaaaauuacuucuuccgccaucaccucgaaaccaauguagaagaacgaaaagaacuaaaagacauaguguauaaaccgcagcucggucuaaaugccauaaaagacguagucaaaguacguauaaaccacuuaggaaaaauaaucuccgucggagaauauuga

SEQ ID NO: 9133 - RNA, 4281 nt, Artificial Sequence
  Cas9 variant
augccaaggaaaaauauauuaggauuagaucuuggaacaacaagcauaggauucgcaaaaauaauagaagaugacgauuaucaauguucaagcgucgaauuaaucggcgucagagugaacccauuaacaacugaugaacaaacuaacuucgaaaaagguaaaccaguuucuguuaaugcagacagaacuuuaaaaagagggaugcgucgaaaucuagauagauaucaauuaagacgcgauuaucuaauagaaauacuaagaacucaccauauuaucacagcugacacaaaacuugccgaggaugguaaaaauacaacgcacacaacuuacgcguugagagcacuagcagcaacugcagaaauaccacucgaggcuuuuguaagaguauuauuagcaauaaauaaaaagcgugguuauaaaagcucaaggaaagcuaagaacgaagacgaaggacaacuaauugaugguauggcaauugcacgaagauuauaugaagaaucacuaaccccaggccaauucucauaccaauugcuuaaagagggcaagaaauaccuacccgauuuuuacagaucagaucucaacacagaacuuaauaaaguuuggaacuuucaaaaacaauuuuacccugaaauauuaacagacgaguucaaaagacaucuagaaggaaaaggccaaagagcgaccgcaguagccuuuuggggacaacacggauuuagcauggcagaaaauaaaggaagcagagaagaaaagaaacuucacgccuauaaauggagaagcgaagcugcucauaaacaacuaacaaaagaagaaguugcauucguaauaacagaaauaaacaaugacuuaaauaaauccucagguuauuuaggugcaauaucugaucgauccaaagagcuguuuuucaacaaacaaacaguaggucaauaucuucaucaacaguuaaaagaaaacccccacacacgacugaaaggccaaguauuuuaccgacaagauuaucuagacgaguucgaaacuauuugggaaaugcaagcgaaauucuacucggcacuaacccuagaauuaaaagaagaagugcgagauguaguaauauuuuaccaaagaaaauuaaagagucagaugggauuaauuucauuaugcgaauuugaaaguaaggaaauagagauagagaaaaauggagaaaaagcaaagaaaagaaucgguuuacgagucgcgccuaaaucuucaccauuauuccaagaguucaaaauauggcaaguucuuaacaacuuagaauuuagaaacaagaaaacgaaagaaguuuuuguacccgaaauggcagcaaaacaacaacuauucgacgaacuaaauauuaaagguaaccuucuagcaagugaagcaauuaaaauccuaggauauaaaacaaaagauugggaagcuaauuaucauacuuuagaaggaaaccgaacaaauaaaucucuuuaugacgcaugguuaaaaauacuugaacuggaaggauacgaugaaaauuuacuaaaacuaucaggaucugacgacauagacgugaguaaaauagagaagccggcacuugaaauacgccaaauggugcucgcaguauuugaagugcuaggaauaucaggagcaauacuagacuucgacgcugaagcagauggaaaggcauuugaacaacaaccagcuuaucagcuguggcaccuucuguauagcgcagaggaugacggcaaaaaguacagccaagaagauauauucaccuaugggcacgacaacauaggacuaaagaaaaagcuaugugaaaaauucgguuucagacccgaacacacuaaaauauuaguaaaugucguguuuagugacgauuacggaaaccugucaucaaaggcaaugagaagaauuuacccguuuauaaaagaacucacauaugacaaagcaugcgcagaagcgggauaccgacauagugcagcaagucucacaaaagaagaaaucgcagcuagaccccuacagaauagacuugauuuauuaaagaaaaacgaacuacguagcccuguaguggagaaaauauuaaaccagauggucaacguaguaaacacccuaguagaugaugaaaaccaaaacaggaaagcaagaggguuaagcgaagacuuucacuuugaugaaauuagaauagaauuagccagagaauuaaagaaaaacgccaaagaaagggcagaaaugaccacuaauauaaauacagcaaaacaaucacacgagaaaauuauacgcauacuacaaacagaguucggcguaccaaauccuagcagaaacgauauaguacgauauaaauuauacgaagaacucaaaaauaacggcuauaaggauuuauauacuaacacuuauauaucaagagauauacuauuuucaaaacaaauagauguagaucauauaauaccacagauguccuuauucgaugacucauucucaaacaaaacaguggucuuccgaaaagauaaccaagauaaaggcaacaagacggcauaugacuacauacuaggaaaauacggugaacaggcuuuagaagaauacauaucaagaaucacaagucuguucgaauugggcaaaaagaauaaagaggagggaauagggaaagccaaguuucaaaaacugcaaaagaggcuaguagauauaggugauggauucaucgaaagagauuuaagggaaagucaauauauagcaaagaaagcgaacaacaugcucuaugccauauguagaagugucgucucaacuucaggugagauaaccgcacguuuaagggaagacugggaccucguaaauguaaugcaagaaauaaauuuacccaaauucagagcacuaggacuaacagagaugguugagaagaaagacggugcccaaaaagaaaggauaacagauuggacaaaacgcaaugaccaucgacaucacgccauggaugcauuagcaauugcauucacaagacacagccacauucaauaucuaaaccaccuuaaugcaagaaaagaugaagcuaacaaauggcacccgguuguauccaaaauagaggagaaagaaacaguguugauuuaugacgaccuuggcaauagaaaaagaaaauuuaaagcaccaaugccaaauuuuagagaaguuguuaaagaacaucuugaaaauguacuuaucagucauaaggccaaaaauaaaguaguaacgaaaaacaaaaacaaaauuaaaacaguaagaggggaaaaggugaaaacagaacuuacccccagaggacaauuacacaaggaaacuauauacgggcgcuacagguacuaugaauccaaagaagagaaaaucggacccaaauucgacgcagaaaugauaggaauggucacaaauccucaauacaagaaacuuuuauuagaaagacuggcagcuaauggaaacgaucccaaaaaggcuuucugggguaaaaaugcucugaauaaaaauccauuguacguggaugaagcaagacaagaacucuuaccggagaaaaucuugcugaggugguuaaacgacgacuauaguauucgaaaagacgucacaccagaaaaccuuaaagauaucaaaacaaucgagaaaauucuugauaaaggaguuaaaaagauauuauuaaaacgauuagcugacuucggaaaugauccaaagaaagcauuuagugauuuagauaaaaauccgaucuggcaaaaugaagcaaaaagaauagcgauaaaaagagugacaauaagcggaaucaagaacgcggcacccuuacaucauaagaaagaccacuuaggaaaugauauacuagaugaaaaaggaaaacaaauaccaucaucuuuuguaucaacaggaaauaaucaccauguugcaauauauagagaugccgaaggaaaccuucaagaacgaguagucucacuauuugaugcaguccaacucgucaacggaggagaaccaguaauugauaaagaauauaauaaaggaauaggguggcaauuucuauuuaccaugaaacaaaacgaaauguuuguauuuccagaugagaaaacuggauuuaauccucgugaaguagauuuacuaucgagcggaaacagaaaacuuauaaguccaaaccuauuuagaguccaaaaacucgcaucaaagaacuacuucuuccgacaccaucucgaaacaagugucgaagaaaagaaagaauugaaaaacauagcguacaaaccucaacuaggacuaaaugcacucucaaauaucguaaaaguccgaaucaaccacaucggagaaauaguaagcgucggcgaauacuga

SEQ ID NO: 9134 - RNA, 4281 nt, Artificial Sequence
  Cas9 variant
augaaaaacauauuaggauuagauuuagguauaacguccauuucauucgcacauaucguagaagaugaaaacaaagagaaaagugaaaucaaagaacugggaguaagaaucgugucacuaacuacagacgaacaaucagauuucgaaaaagguaaaucuauaacaacaaaugcuaauagaacacuaaaacacggggcgagguuaaacuuagauagauaucaacaacgacggaaguacuuaauugaccuacuacaaaaagcgaaccuuaucacuucaucaucuauauuagcagaaaacgguaaaaacacuacacacucaaccuggcaacuaagagcgaaagcuguaacagaaaggauugaaaaagaagaauuugcaagaguauuacuagcuauaaacaagaaaagaggauacaaaaguucaagaaaagccaaaaccgaagaugaaggacaagcaauagacggaauggcuauagccaaaagacucuaugaugaaaacuuaaccccgggacaauuaucacuucaacuacuccaacaaaauaagaaacuacuaccagacuucuacaggagugacuuacaaagagaguucgaucuagucuggaacuuucaaaaacaauucuauccagauauacuaacagacuccuucuauaaagaacuccaaggaaaaggaaaagacgcaacaagcaaagcauuuagcaaaagauaucacuucgacacugcagaaaacaaagguaguaaagaaucagugcgacuccaagcauaucaauggagagcagaagcaauuagcaaacaacuuucaaaagaagaaguagcauacguacuuaccgaaauuaacaacaaccuaaauaaugcaucuggauaccuuggugcaauuuccgaccgcucaaaagaacuauauuucaacagacaaacaguuggacaauacuuauacgcccaauuacaagaaaauaggcacaauucacucaaaaacaaaguauuuuaccgccaagacuaccucgacgaguucgaacgcaucugggaaacccaggcuucauuccauaaagaacuaacagacgaacuaaagaaacaaauccgugauguugugaucuuuuaccaacggaaacuaaaaagccaaaaaggauuaauaaguuuuugugaguucgaaucuaaagaaauugaaauagaaaaagacggaaaaacaauaacaaaaacaauaggggcaagaguagucccaaaaagcuccccucuuuuucaagaauuuaaaaucuggcaaauauugaauaauguaacuugcaaacgaaaaggcauucggaagaagaaauccagugccaaaagcaccgaacuagacuuauucaaugaaccuucacaaacaauauucucucuggacauggaauguaaacaauuacuauucgaugaacuaaacuuaaaaggugaucuuaaaucagauaaagugcuaaaacugcuaggauauuccccgcaagaaugggagauaaacuauaaucaauuagaaggaaauagaacccaaaaagcauuauaugaagcauaucuaaaaaucgucgaaauggaggcccacgacguaaaagacauucuacaaauaaaaagcgcuaaagacgacuggucauuagacgaaucaccauuaucagccucagaaauaaaagaaaaagucaaagauauauuucaagcccucggaauuuguacaaaaauauuauauuuugacccacuauugccgguaaaagaguucgagaaacaagacucauaccaacuauggcaucuacuauacucauaugaaucugacgacucaacauccggaaaugaaacauuauauagaauccucgagaagaaauaugcauucaaaagagaacacgcucgaauccuagccaacguagcauuacaggaugauuauggaucguuaucaacaaaagcuauacgaaaaauauacccaaacauaaaagaaaaucaauauucaaaggcuugugaauuagcuggauacaaacauuccaaauuaagccuaacuaccgaagaauuagaagcacgagaacucaaaaauauaauaccgcuacuaaagaaaaaugcacuaagaaauccgguuguagagaaaauacuuaaccagaugauaaauguggugaacgcucuaauagagaaaaacucagaaagagacgccgaagggaaaaucacaaaauacuuccacuucgacgaaauaagaaucgaauuggcgcgagaacuaaagaaaaacgcacagaaaagauacgaaaugacacaaaacauuaacaaagcaaaacucgaacaccagaaaauaucagaaauucugcagaagaaauuuggaaucaaaaacccgacaaaaucagauauaauaagauacagacucuaucaagaauuagaacauaauggauacaaagaacuauauacaaaugcuccaaucgcgagggauauguuauuuagcaaaaauauagaaaucgaacacauagucccuaaagcaagagucuuugacgacucauuuagcaacaaaacucuuacauuucacagaauaaacucaaauaaaggagaauacacagcauuugauuacaucacaucacuuaacagcgaggaagaauuaaaccaguauuugacuagaguagagaacgcauauaaaacaaaaagcaucucgcuaacaaaauauaaaaauuuacuaaagaaagcaagcgaaauaggagacggauucauaaacagagaucuacgagauacucaauauaucgccaagaaagcaaaagaaauacuauuucagguuaccaaaaacguacucuccacaucaggaucuaucaccgauagauuaagggaagacuggggccuaguugacguaaugaaggaacugaacaugccgaaauaccaaucacuaggucuuacagaaguagaagaacgcaaagaaggaaacaaggugacaguaaucaaaaauuggacaaaaagaaacgaccaucgacaucacgcaauggacgcacuuacaguagcguucaccaaacccucauacauucaauaccuaaaucaccuaaaugcaagaaaagaugaaaacaauaaaaacuacucgguaauacuagcgauagaagagaaagaaacgauaaaaguacccacuaauaauggcaaaaauaagcgaguauucauugaaccuauaccaaacuuuagacagguggcaaagaaacacuuagaagaaauauuuauuucgcauaaagccaaaaauaaaguugucaccaaaaaugucaacaaacccgcagggaccgacaaacaacaaauaacccuaaccccuagaggacaauugcacaaagaaaccauauaugggaaauaccaauauuacguaaacaaagaagaaaaaguaggagucaaguuugaugaaagaacaauaacaaaagucaguaauccuuuauauagggaagcgcuauuaaaaagacuacaagccaacgauaacgaucccaagaaagcauuuaccgguaaaaaugcgcuuucaaagaauccaaucuaccuagaugaaacuaaaacaaaaacucugccggaaaaaguaaacuuaacuuauuuagaagaagauuucuccauacgcaaggauauaagcccugacaacuuuaaagaccugaagucuauagaaaaaguaauagaccaggggguaaaaagaauuuuaauaaaaagauuacaagacuacgacaaugacccuaagaaagcauucguagaccuugagaaaaacccgauauggcuaaacaaagagaaagguauugcaauaaaacggguaaccauaaguggugucucaaacgcccaacccuuacauauaggcaaagaccaucucggaaagacaacccugaacaaagaaggaaaugaaauaccaguugacuacgucucaacagggaauaaucaucauguagcaauauaccgcgacaaagagggcaaccugcaagaacaaauuguuuccuucuuugaagcggucguccgcacacaacaagggcuacccauaauagacaaaacauacaaacaggaagagggauggcaauuccuauuuaccaugaaacaaaacgaaauguuugucuuuccuaacgcaacaacagguuucaaucccgcggaaauagaccuuuuagaucccaaaaacaagaaacuaauuucacccaacuuauucagagugcagaaaaucgccacgaaagauuacuucuucagacaucaucuagaaacaaacguagagaccgacaacguacucaaaaauacaacauggaaaagagagggccuguccggauuaaaagauauugugaagguaagaaucaaccauuuaggcgauauagucagcauaggugaauacuga

SEQ ID NO: 9135 - RNA, 4281 nt, Artificial Sequence
  Cas9 variant
augaaacacauuuuaggacuagauuuaggaacuaacuccauuggcugggcguuaauaaaacaagacuuugaaaacaaacaaggggaaauacuuggcaugggaucccgcauaauaccgaugucacaagauauucuaggagacuucgggaaaggaaacucaguaucucagaccgcugaaagaacaaaauaucgcuccguaagaagauuaagagaacgcuuucuauuacgaagggaacgacuacauagaauauuaaauguacugggcuuccuaccagaacacuacgcaucacaaaucgacuuuacaaaaagauuuggcaaauucaaagaagaaacggaaccaaaauuaguauauagcaaugaaggauucaucuucaagaaaucauuugaagaaaugcuauccgauuucaaaacucaucaaccccaauuauuagaagauaauaagaaaauaccauaugacuggacuauauauuaucuacggaagaaagcacuaucacgaaaaauagaaaaagaggaauuagcauggauccuccuaaacuuuaaccaaaaacgaggauacuaucaacucagaggagaagaagaagaagagaauccaaauaaacuaauagaauuuuauagccucaaaaucgucgacguccuugcagacgaaccccaaaaaggcaaaagcgauauaugguacucacuaauccuagaaaauggauggaucuaucgacgaucaagcaaaacuccacucuuugauuggaaagagaaaaccagggauuucaucgucacaauagaccuaaacgacgauggaaguguaaaaacggauaaagaagguaacgagaaaagaucguuuagagcgccgggcgaaaacgacuggacauuagucaaaaagaaaaccgaacaagaaauagauagcuccaggaaaacuguagggacauacauauacgaaacauugcugaaaaacccgaaacagaaaauaaaaggaaaacuuguucgaacuauugaacgaaaauucuacaaaacagaacuaaaacaaauccuagagaaacaaaaagaauuucaucccgaauuacgacaagacgaucuguauucagauugcguaagagaacuauacaaaaacaacgaagcacaucaauuaacauuaagcaagaaagauuucguacaucuauuuauggaagauauaaucuuuuaucaaagaccgcuaggaagucaaaaaucuucaauaucaaacugcacacuagaauuuagaaaauauaaagacgaaaauggcacggaacacacacaauaucuaaaagcaauacccaaauccaacccuuacuaccaagaguucagaaucuggcaauggauguauaaccugaacauauacaagaaagaagacgauacaaauguuacaaaagacuuccuaaacacaaaagcagauuucgaaucauuguuugaauuuuuaaacaacagaaaagaagucgaucaaaaagccuuauuaaaacauuucaaacuaaacgacaaaacgcauagauggaacuaugucgaagauaagaaauacccguguaacgaaaccaaaacaaugauacucucacgccuagauaaagucgaaaauaucuccgaugauuuccuaacaagagaaauggagcagaaaauauggcauauuaucuauucuguaaacgacaagguugaguacgaaaaagccuuaaaaaguuucgcagguaaaaacaaucucgaagauaauucauucuucgaggcuuucaagaaauuuccaccauucaaaucagaauauggugcauucucggagaaagcaaucaagaaauuauuaccucuaaugaggauggguaaguucuggaauuauaauaacauuagugaacaaucuaaaucacguauucagaaaauaauaacgggagaauacgaugagaauauaaaagacaagguaagagaaaaagcaauccacuugaccacugaaaccgacuuccaaggcuuacaacuauggcuaguccaauauauaguauauggcaggcauucagaagcugccaugcuaggcaaauggaauagcgcagaugaccuagaggaguuuuuaaaagaauuuaagcaacauucacuaagaaauccgaucgucgaacaaguaaucacagaaacgcuuagaguugucaaagauauauggcaaaaauacggcaauggugcgaaagacuuuuuccgagagauucauaucgaacuaggacgagagaugaaguuacccgcugaagaacgagaacgauuaacacgucaaauaucagaaaaugaaaacacaaacuuucgcauaaaagcacuacucgcagaaaugauggacgacaacuccguagaaaauguucguccauuuucaccgaugcaacaagagauacuuaaaauauaugaagaagguguacuaaacagcgacauagaaauagaagacgauauuuuaaaaauaucaaagaccgcccaacccaguucaucugauuuaaaaagauacaaauuaugguuagaacagaaauauaaaucaccauauacagggcaaaucauuccauuaaauaaacuauuuaccccagaauacgaaauugaacauauaaucccccaaucccgauauuucgacgacagcuuuacuaauaaaauaauaugugaaucagcugugaauaagcuaaaagacaauuacauuggucucgaguucauaaagaaacucggcggauccauaguagaaugcggaaacggaaaaucuguagccauacucaaacacgacgcuuaugaagacuucaucaagaaacacuaugcaaauaaccgaucaaaaagaaauaaauuacucuuagaagacauaccagagaaaaugauugaaaggcaaaugaacgacacaagauacauaagcaaauacauuucuggcgucuuaucaaauaucguacgaguugaagacgguacagaugaaggugucaacaguaagaacauaguaccugguaacggaaaaaucaccacccaacuaaaacaagauugggguuugaaugauguauggaacgaccugauucucccaagauuugaacgaaugaaccacuuaacuaauucaacagacuuuacagcguggaaugaaaaucaccaaaaauucuuaccaacaguaccugucgaguucucaaaaggauuuucaaagaaacgcaucgaucaccgccaccaugcacuagaugccuuagugaucgcaugcgcaacaaaagaucacguaaauuuauuaaacaaccaaucagcaaaaucagacacuaaaagauaugaccucaaaaagaaacuaaugaaguuugaaaaaguggccuauaaccacccccaaacuggggaaaggauugaacgcgaagcgccaaaacaauuucugaaaccaugggaaacauuuacaaucgacgccaaaaaucaccucgaaaccauaauuguaucauuuaaacaaaaccuaagaguaaucaacaaagcaacuaacuacuaugaaaaauacguugaaaaagaaggaacaaaaguaaaagaaagaguugaacaaaaaggaacaaacugggcuauaagaaaaccaaugcacaaagaaaccguauccgguaaaauugauuuaccgcgaaucaaaguacccaaaggaaaaauauugacagcuacucgcaagagcuuagacacaucauucaaucucaaaacuaucgguucaaucaccgauacaggaauacagaaaauucucaaaaacuaucuacaauauaaagacaacaacccagaacuagccuuuagccccgaaggcauagaagacaugaacaagaauaucgaaaaauucaacaacgguaaagcucaucaaagcauuuccaaaguacgcguauuugaacuaggaucaaaguuuccacuaggccaauccggaaauaagaaagaaaaauauguggaggcagcaaaaggaacgaaccuauucuuugcgauauaccaggacaaaaacggaaagcguucguaugaaacuaucccucuaaaugaaguaauugaaaggcaaaaacaaggacuuaguguaguagaccuaaagggaguugaugacuuuuaucuaagcccaaaugaccucguuuauguuccaucugaagacgaacuagaaaauauaagcaugauagacuucaauaaaauguccucagaacgaaucuacaaaguaguaucuuuuacaggaaaccaaauuuucuucgucaggcaagacauagcaacaucagucguaaacaaagcagaguucaguacacugaauaaaauggagagagcaauagaugggacaaugauuaaagaaacaugcgugaaacuacagauagauaggcuaggaaacauaaguaaaauuuga

SEQ ID NO: 9136 - RNA, 4281 nt, Artificial Sequence
  Cas9 variant
auguacaacauaggauuagauaucggaacagggaguguuggguggugcuugacagacgaaaacggauaucuauuaaaaguaaaucgaaaagggaauaacggaaacaccuacagaaacagugcauggggaguaaggcuuuucgaaagcgccgauacagcggccgauugcaggauaaaacguucaacaagacgcagguacaaaagaaggcgcacaagaauuauagaacuaaggaaaauaaugagugacaugauaaugccaauagauccuaauuuuuacgcccgacuagaugaagccuuccuguggaaugaagacaaaagcgacaaagcuaaagccccauuucuacuauucaacgauaauggguacgacgacguuaaauauuauacugauuauccaacuauauaccaccuaaggaaacauuuauuagaaaccaaagaaaaagcagauccaagauuuauauaucuagcgcuucaccacaugaugaaauauagaggacacuucuuauuugaaggucagagcuuugaagcaauugauaauauagaagacaccuuuauagaauuagaacaucuaguaaacgucuauguaaaagaaaaagaagacacagacaacaaugcugaaaacaaugcguuauaccaagaaaugaaaaacuaccuagcggacaauaaagucaaaaauaaagauaagaaagaauauauaacugauaccuuuauuaaagccgauuacgacaacaaauacaguaaagaacuagcagcagcaguccuaggauacgaguucaauguuggaauaauaguuaaugacaauagucuaacagaugaagauggaaaagcccuaaaagcaaaauucgcagacgcaaaauacgaagaaaaagaagaaaaacuaagugacacacucggagaaagauauuacauaauagaaacgcucaagaaaauauacaguuggaaaguucuacacagcauccucggagacaacaaauaucuaagcuaugcaaugguugauaaauaugagaaacacagugagcaauuaaaagcccuaaaauaucuauuccauaaauauacaucacaagaugaauauucagaauuuuuccaccaagagaaaaacaaagaaggaaaauauauuguaaauuaugccaacuacaucaaaggcauaaaacgucucucgaaugaaacuaauaagaaauauaauacaaaacaacaauuauaccaaagcauaaugaaaaucuuaggcgaaagagccgcagaugacgaaguauauaagaaaauauuagucgaaauggaacaagaaacauuccuugagaaaaucaauaauguagacaacagcgcgauacccuaccaacuaaauuuaauggaaauggacaaaauuuuaacacaacaaggcguauacuauaaagaacuacgagauaacaaagaacuguuacuuaaaauguuaacaaguaaaaucccguacuacguuggcccacucaauaacaauucaaacggaaacagaaacuuugcuuggaugaccaagaaagacggcaaagaaaacgaaaaaguauacccauggaacguaaaagauguagucgauaucgacguaacagcagaagauuuuauaacaaggaugacaaacuauugcaccuaccuacccaacgaaaaaguccuaccaaaagagagcuuacuauaucaaagauacauguuacucgaagaacuaagccaaauaaggauagacggaaggaaacucucaaaagaagacagaaaagcaauaauaaacgaccuguuuauuggaaaaggaagagugaaaguuagcgacaaagacuucaaagaauaccuaaacaaaguaaacuauguuaaaguaaacggcaaagguuaugacgucacuggcuaucaaagugacgauggauucgcgugcgcauuaucaucuuauaacaaauucagacguauucugggacacauagacgaacaaaaugagaaaaugauagaagacaucauauacuggaucaccguauucgaagacaaagacaucguaaaacgaaaaauaaacaaacaauaugcagacagauuaucagccgaacaguuaaagaagauccuuaaauuaaaauucaaaggauggggaagauauagcucaaaacuacugaauggaauaaaaggggacauggggaccacaauaauugaaauguuagaggacgccgaugaaagauucgcauauugcgauuauuguccgaauuucaugcaaauaauaaauaaagaugagaaaauaaaacaaauaauugacgacaauagaccaagauacgacgguacaaaagauuuacuagauguaauacaagauaugcauacaaguccagcaaauaggagagguauauggcaaacaaugaaagcaaucgaagaaaucauugaauauaugggagaaaaaccccaacaaauauauauagaguucgcacgagaggacgauccaaaagccaaaaacaaaagagcagacucaaggaaacgagccaucgauaaggcacuaaagaaacugaaagaagacgucguugacgaguacaaugaaaaaguguacaaggaacucaagcaauacgaaaaacguuuagaugaagagaaaguuuacuuauacuucaugcaaaauggaaaagaccuauauuuucccgacaaagagcuuaaucuagacgaauuagaaaaacucgaaaucgaucauaucaucccauacucauuauccgacgacgauagccuagacaauaaagcauuaguacucaaaggaaacaaucaaaacaaaggaaauaaaauaguaaaagaagcauucccacaacucuucagcaacucagggacaguuaauuacuggaaaaaccuaaagaaagcaggguuaauaucagagaagaaauacaacaacuuacagaaaaacaauguagaugauauauuaacaaagggcuuuaucaacagacaauuaguagaaacacggcagauaguuaagucuguggcaaaccuaauacuagauuacuauaacgaacagaucgacguuauugaaguaaaagcaucguuaucaacuucaguacgaaaaaugcuaacauaugagaagaaagacaauaauggguuuuggaucgaaaacaaagacaacugcauguucuauaaaaaucgcgauaugaaugauuaucaccaugcucaugacgcauaucucgcaaacauuauagguuuauauauacagaaaaacuauccacgacuacaaaaggaacuaaacuauagccaauaccgaagaaucuggcguaaguacuaugaaaauacuaaaaacaauaauggaguaaauugguucgcuaccuugggaaaauuuucaagcaauaacgaagaagcagauugguaugggcaagacauaauagcauauaugagaaaaauauucuguuauagagauguuuuaaucaguaagaagguagaggaaaauacaggugcuuuuuauagugaaacgaaauacccaagagaagacaaggcuggaucgaaauuaguaccccuaaaacaagguaauaauaugcgaggagccaacaaccugaaggaauuggaugcacgaaaauauggaggauacaaaggaggagaaaaagcguauuucgucuuaguaaaauacugcauagagaaagcauuaaagaagaaagucaagaaagaauaccacauggaguucguugaaauacccgucuacauugcgagggguauuaaaaauaaagacauaaaucucuacgauuacguaugugacauauuaaaugaagcaaacaaaaauaguguugcagaugucgagauacuccggaauaaaguaccaaaguaccaaaugauaauuggugagaauggugaagaauauuaccucguuagugcaacugaaguaaucaacucaaaacaauucguauuaggaggagcgaaccaacaauacaaccgucuauuaaacuacauaaaauacggcaaaaacgauaaauggcaguauauacaaacagaacuguuagaugaacaacuuauaggauuauacaacuuacucaucgcaaaaauaaaagacgaauacaaaggcuucuccaaggaggcaguacgaauacaagaaaacaacucauucgauaaacuagauguaaaagacaagaaagaguucauagcagaaaugauuaaguuagugcaaccagacucagauuauccauaccuaggaaaauacgcaacaggucuuucuaacagaaugggccgaaaaacaggagaaaaaguaggcaagaaaauaacgcuaguagauaaaagugucacggguuuauaugaaagaagaacaacauucgaacucgaagaugacuccagcacuaaaagcugcuga

SEQ ID NO: 9137 - RNA, 4281 nt, Artificial Sequence
  Cas9 variant
augaaaaauauccuaggacuggaucuagguacaacaucaauuggcuucgcacacauuguugaagaugaaaauaaagaaaaaucugagauaaaagaacuugguguucgaauagucucauugaccaccgacgaacaaagcgacuucgaaaaaggaaaaucaauuacaacuaaugcaaauaggacacugaaacacggagcacgccuaaaccucgaucguuaccaacaacgaagaaaauacuuaauagauuugcuacaaaaagcaaaccuaaucacaccaucgucaauucuugcagaaaacggcaaaaauacaacacauucaacguggcaacuucgcgcaaaagccguaaccgaacgcauagagaaagaggaauuugcacgaauacuacuggcaauaaauaagaaacgaggauauaaaucaaguagaaaagcaaaaacagaggacgaaggacaagcaauagacggaauggcaauagcaaaaagacucuacgaugaaaaucuaaccccaggacaauuaucacuacaacuguuacaacaaaacaaaaagcugcuuccugacuucuacagaagcgacuuacaaaaagaguucgaccucguuuggaacuuccaaaaacaauuuuacccagacauucuaacugacauauucuacaaggaauugcaagggaaaggaaaagaugcuacaucaaaggcauuuuccaagcguuaccauuuugacaccacugaaaauaaagguucaaaagaauccguaagauuacaggcuuaccaguggcgagcugaagcaauauccaaacaacuaucaaaagaggagguagcguacguacuaacagaaauaaauaauaaucucaacaaugccucaggauacuuaggugccauuucggacagauccaaagaacuauauuucaaccgucagacagugggucaauaucuauaugcuaaauuacaagaaaauaggcacaacucccuuaaaaacaaaguauuuuauaggcaagacuacuuagacgaguucgaacguaucugggaaacacaggcgagcuuccauaaagaacuaacggacgaacuuaagaaacaaauaagagacguuguaauauuuuaccaacgaaaacccaaaagucaaaaaggauugauaaguuucugcgaauuugaaucuaaagaaauagaaauugaaaaagauggaaagacuauaaccaaaaauauuggagcaagaguaguacccaaaagcagcccccuauuucaggaauuuaaaauauggcaaauacucaacaaugucauuugcaaacgaaaaggcauaagaaagaaaaagaucagugcaaaaacaacccaacuugacuuacuaaacgaaucuagccaaacaauauuuucccuagauauggaaugcaaacaacuacuuuuugacgaacucaaccuaaaaggggauuuaaaaucugacaaggugcuaaaauuauuaggauacucaccccaagaaugggaaaucaacuacaaucaauuagaaggaaauaggacucaaaaagcccuauaugaggcauacuuaaaaauagucgaaauggaagcucacgaugucaaagauauccuacagaucaaaagcgcaaaagaugauuggagcuuagacgaaucuccauugucagcaucggaaauaagagaaaaaguuaaagcgaucuuucaaacacucggaaucugcacuaaaauacuauacuuugauccacuucuacccgucaaagaauuugaagaacaagacucauaccaacuauggcaccuuuuauauaguuacgaaucagacgauucgacauccggaaacgaaacauuauauagaaucuuagaaaagaaauacgcguuuaaacgagaacaugcacguauacuagccaacguggcgcuacaagacgacuacgguaguuuaucaaccaaagccauaaggaaaauauauccaaacauaaaagaaaaccaauacaguacagcuugugagaaagcaggauauaaacacucaaaacucucacuaacgaccgaagaauuggaagccagagaacucaaaaacauaaucccucuccuaaagaaaaacgcuuuaagaaaucccguaguagagaaaauccugaaucaaaugauuaauguaguaaacgcacuuauagagaaaaauuccgaaagagaugcagaaggaaaaauaacaaaauacuuucauuucgaugaaauaaggauugaacuugcgagagaauugaaaaagaacgcucagaaaagauacgaaaugacccaaaauauaaacaaagcaaaauuagagcaucagaaaaucucugagauauuacaaaaagaguuuggcauuaaaaauccaacaaaaagcgauaucauacgcuaccgccuuuaucaagaguuagaacacaauggauacaaagaauuauauaccaacgcuccgauugcaagagacaugcuuuucuccaaaaauauagaaauagaacacauaguuccuaaagcacgaguuuucgaugauucauucucaaauaaaacacuaacauuucacagaauaaacagcgacaaaggagaauacacagcguucgauuauauaacaucuuuaaacucagaggaagaacuaaaccaauaucucacacgggucgaaaaugccuacaaaacuaaauccaucucaccgacaaaauauaaaaacuuauuaaagaaagcaucugaaauaggcgacgacuuuauaaauagggauuuaagagacacucaauacauagcaaagaaagcaaaagaaauucuauuucaaguaaccaaaaacguacucuccacgucaggcucuauaacagaccgucucagagaagauuggggacuuguagaugucaugaaagaacuuaauaugccuaaauaucaauccuuagguuuaaccgaaguagaagaacgaaaagauggaaacaaaguuaccgucauuaaaaacuggacuaaaagaaaugaucacaggcaccacgcaauggaugcucugacuguagccuucacaaaacccaguuacauacaauaucucaaucaccuaaaugcgcggaaagaugaaaacaacaaaaacuacuccguuauauuagcuaucgaagaaaaagaaaccauaaaaguaccuacaaauaauggcaaaaauaaaagaguauucauagaaccaauuccaaauuucagacaaguugcaaagaaacaccuugaagaaauauucaucagucauaaagcuaaaaauaaagucguaaccaaaaauacaaacaaaccugcaggaacagauaaacaacaaauaacacuaacaccccgcggacaacugcacaaagaaaccaucuacggcaaauaccaauacuacauaaauaaagaagagaaaaucgguguaaaauucgaugaaagaacaauagccaaaguaaguaacccuguguauagggaagcauuauuaaaaagacuacaggcaaaugacaacgacccuaagaaagccuuugcaggcaaaaacgcacuaucuaaaaauccgaucuaucuagacgaaagcaaaaccaaaacgcuacccgaaaaagucaaucuuacauacuuagaagaggauuucaguauaagaaaagacauaucaccagacaacuucaaagauuuaaaaucaauagaaaaaguaauagaucaaggagugaaaaggauuuuaauaaaaagguuacaggcuuacgacaacgacccaaagaaagcauuuguagacuuagagaaaaacccuaucugguuaaacaaagaaaaaggaauugcaauuaaaagaguuacaauauccggcguaaauaaugcacaaccacuccacauaggaaaagaccaccuaggaaaaacaacucuaaacaaagaaggcaaagaaauuccuguugacuauguaucaacuggaaauaaccaccauguagcgaucuaccgcgauaaagaagguaaucuucaagaacaaauagucucauuuuucgaugccguuguacgggcucaacaagguauaccgaucauagacaaaacuuauaaacaagcagaaggcuggcaauuuuuguucaccaugaaacaaaaugaaauguucgucuuuccuaacgcaacaacaggauucaauccugcggaaauagaccuauuagaccccaaaaauaagaaauuaauuaguccaaaucuguucaggguacagaaaauagccacuaaagacuacuucuucaggcaccaucuggagaccaacguggaaacagacaauauucucaaaaacguaacauggaaaagagagggauuaaguggucuuaaagauauaguaaaaguaagaaucaaccaccucggagauauuguuuccaucggggaauacuga

SEQ ID NO: 9138 - RNA, 4281 nt, Artificial Sequence
  Cas9 variant
augaaaaacauacugggacuagaucucgguacaacaucuaucggauucacccauauuguagaagaugaaaauaaagagaaaucugaaauaaaggaacuagguguaagaauugucagccucacuacggacgaacaauccgauuuugaaaaaggaaaaucaauuucaacaaacgcaaacagaacauuaaaacacggagcacgauuaaaccuagacagauaccaacaaagaagaaaauuccucauugaccuacuacagaaagcaaauuuaauaacgucaagcagcauacucgcagagaacgguaaaaacacaacacauucaacuuggcaauuaagggcaaaagcagucaccgaaagaaucgaaaaagaagaauuugcuaggguuuuacuagccaucaacaaaaagcgagguuacaaaucaucacgaaaagcuaaaacagaggacgaaggacaagcaauagauggcauggcaaucgcuaaaagacuauacgaugaaaauuuaacaccagggcaacuaaguuugcaauuacuacaacaaaauaaaaaauuacucccagauuuuuacagaagugaucuacagaaagaauucgacuugguauggaacuuucaaaaacaauucuaucccgacaucuugacggacucauuuuacaaagaauuacaaggaaaagguaaagacgcaaccucgaaagcauucaguaaaagauaucacuucgacacagcugaaaauaaagguucaagagaaucaguaaggcuccaagcauaucaauggagagccgaagcuaucaguaaacagcucucaaaagaagagguagccuacguccucacagaaauaaacaacaauuuaaauaaugcgucaggauauuuaggagcgauaucagaccguaguaaagaauuauacuucaauagacaaacaguaggucaauaccuuuacgcacaacuccaagaaaacaaacacaauucucuaaaaaacaaaguauucuacagacaggauuaccuagaugaauucgaaagaauaugggaaacccaagccucauuucauaaggaacuaacagaagaacuuaaaaaacaaauaagggacguaguaauuuuuuaucaacguaaacuaaaaucacaaaaaggacuaauaucauucugugaauucgaguccaaggaaaucgaaaucgaaaaagacggcaaaacaauaaccaaauccauaggagcgcgaguggucccaaaaaguagcccucuuuuucaagaguuuaaaauauggcaaauacuuaauaauguaaccugcaaacgaaaaggaaucagaaaaaaaaaauccucagcaaagagcacagaacuagaucuauucaaugaaccaucacaaaccauauuuucucuugacauggaaugcaaacaacuacuguucgaggaauuaaaucuaaaaggcgaccuaaagagcgacaaaguacuuaaacuccugggcuauucuccgcaagaaugggaaauuaacuauaaccaacuagaagguaaccggacccaaaaagcccuauacgaagcguaccuaaaaauagucgaaauggaagcacaugacguuaaagauauauuacaaauaaaaucaacaaaagaugacugggcauuagaagaaucaccuuuaagugcaucagaaauacgugagagaguaaaagcgaucuuucaaacacuaggaaucugcacaaaaauucuauauuuugauccguuacuaccaguaaaagaguuugaagaacaggacucauaccaacuuuggcaucuacuauacucuuaugaaucagacgauuccacaucuggaaacgagaccuuguaucgcauacucgaaaaaaaauacgcuuucaaacgagaacacgcgaccauccuagccaacgugacgcuucaagacgauuaugguagccuuaguacuaaagccaucagaaaaauuuauccauauauuaaagaaaaucaauauuccacagcgugugaaaaagcugguuauaaacauucuaaacuaucgcuaacaaccgaagagcuggaagcuagagaguuaaaaaacaucauaccuuuacucaaaaaaaaugcacuacgaaauccaguaguagaaaagauucuaaaccaaaugauaaacguaguaaacgcacuaauagaaaaaaacagcgaacgagaugcugaagguaagauaaccaaauacuuucauuuugacgaaauaagaauagaacuagcaagggaacuaaaaaaaaaugcacaggaaagauacgaaaugacacagaacauuaauaaagcuaagcuagaacaucaaaaaauaagcgguauauuacaaaaagaauuuggaauaaaaaauccaacaaagucagacaucacacgcuacagacuauaucaagaacucgcucauaauggguauaacgaucuauacacaaacacuuauaucccuaaagaauuauuauucuccaaaaacauugacauagaacauauuguaucaaaggcaagagucuuugacgacagcuucagcaauaaaacacuagcuuuccgagaauuuaacaucaaaaagggagaaucuacagcauucgacuauauuaccagccuuaacaaugaagaagaauuaaaccaauauuugaacagaguagaaaacgccuacaaaaccaaaaauauaaguccagcgaaauauaagaaccuacuaaaaaaggcauccgaaauaggagacggcuuuauaaaccgugacuugagagacacucaauacauagccaaaaaagcaaaagagauccuauuccaagucacaaaaaauguacuaucaacauccggaagcaucacagaccgccugagagaagauuggggucuggucgauguaaugaaagaacuuaacaugccgaaauaccaaucgcucggacuaacagaagucgaggaaagaaaagaaggaaacaaagugacuguuaucaaaaacuggacaaaacgaaacgaccacaggcaccaugcaauggacgcacuuacaguagcauucaccaaaccuucuuauauacaauaccugaaucaucuaaaugcgagaaaagacaaaaauaacaagaauuacucggugauacuagcuauagaagaaaaagaaacaaucaaaguuccuacaaauaacggaaaaaacaaacgaguguucauagaaccuauaccgaacuucagacaaguagcaaaaaaacaucuagaagaaauauucauaucacauaaagcuaaaaacaaaguagugacgaaaaacaccaauaaaccagcagguacagauaagcaacaaauuacacuaacuccgagaggucaacuucauaaagaaacuguauauggaaaauaccaauauuacguuaauaaggaagaaaaaauugguguaaaguucgacaaagaaaccauagcaaaaguaagcaacccaguauauagagaagcucuacuaaaacgccuucaagccaaugacaacgauccaaaaaaagcauuugccggcaaaaacgcacuuucaaaaaacccuauuuaccucgacgaagcaaaaacaaaaacauuaacugaaaaagucaaccuaacuuaccuggaagaagauuuuagcauuagaaaagacauaucacccgauaacuuuaaagauuuaaaaucuauagaaaagguaaucgaucaaggaguuaaaagaauuuuaauaaaacgucuacaagauuaugacaacgaucccaaaaaggcuuuuguagaccuagaaaaaaacccaauuugguuaaauaaagaaaaaggaauagcuauuaaacgagugacaauaucaggagucaauaacgcacaaccauuacauauagggaaagaccaccucggaaaaacaaccuugaauaaagagggaaaagaaauaccuguagauuacguaucaacggguaauaaccaccacguugcaauauauagagauaaagaagguaaucuucaagagcaaauagucucauuuuucgaagcagugguaggagcccaacaaggucuaccaauaguagacaaaacauacaaacaagcagaaggauggcaauucuuguuuaccaugaaacaaaaugagauguucguauuucccaaugaagccacugguuuuaauccugcggagauugaccuauuagacccaaaaaacaaaaaacaaauaaguccuaaccuauucagaguccagaagauugcaacaaaagauuacuuuuuucgacaccaccucgaaacaaacguagauacagacaacguguuaaaaaacacaacauggaaaagagaagguuuauccgggcuaaaggacaucguaaaaguaagaauaaaucauuuaggcgauaucguaaguaucggagaauauuga

SEQ ID NO: 9139 - RNA, 4284 nt, Artificial Sequence
  Cas9 variant
augaagaaaauacuaggcuuagaccuagguaccaguucuaucgguugggcauuaguaaaugaagcggaaacuagcgaagagaaaucuucaauuaucaaauuaggaguaagaguaaacccauugacaguagaugaacuacaaaacuucgaaaaaggaaaaucaaucacuacgaacgcagacagaacagcaggacgaucaaugcggcgaaaucuacaacgauauaaacuuagaagagaaaaccuaauugaaguacuuaaagaguauaauuuuauaacggacgaaaugaucuuaagcgaaaacggcaaucgaacaacauuugaaacauaccgcuuaagagcaaaagcugcgguagaggaaauaagccuugaacaauucgcuagaguuuuacuaaugauaaacaagaaaagaggcuacaaauccucaagaaaagcuaaaggagcagaaaauggcaccuuaaucgauggaauggaaguagcaaagaaaauguacgaugaaggcaucacaccaggugaacuaugccuacagcuacucaccgcaggcaaaagauauuucccagacuuuuauagaucagacuuacaggcagaauuugaucgcauuuggaauuuccaaaaacaauuuuauccagacagccuaauugauaaaguaaaagaugaagugagaggcaaaaacaaaucgcaaaccugggcaaucuuagcaaaauauuuuguauggaaagaaguagaaaacucuuggaaugaggaagaagcacaaacacgaagagucgagaaagaauauaggcuaguagggauaaaaagaggaguaaaaagagaagaacuaaaacuagaaaacuuccaauggagaguaaaagcucuaagugaaagaaugaacccagaggaauuagcaauaguacuacaagaaaucaaugaacaaauaaguaauucaucaggauauuuaggagcgauuagcgacagaucaaaagaauuauacuuuaaccgucaaacaguuggccaauaccagauggcuguucuugauaacaacccaaauauuggacuccggaauauggucuuuuauaggcaagauuaucuugacgaauuuaauaccauaugggaaaaacaagcagaguuccacaaagaauuaacagaagaccucaagaaagagauacgugauaucguaaucuucuaccaacgaagguugaaaagucaaaaaggauuaauaaacaucugugaauuugaaagacgacaaaucgaagucgaaauagauggcaaaaagaaaauaaaaacaauaggaucccgaguaaucccucgaagcucaccacuauuucaagaauuuaaaauauggcaaacguuaaaugacauagaaguaagcguucucggugucaaaaacaaaaggaagaaacaagacgacaauaguaccacacugcuagauucagcagaaaacauugauucgcuaaaacuaaacguaucaaggccacuugacgcagaugaaaaaucgcuacuggcaaaagaacucuuuauacgagauaaacuaaccaaauccgacguauuaaaauugcuuuucaauaauccacaaaaucuaaaucucaauuucaaaaacauagacgguaacagaacagguuccgcacuauaccaagcauuuucgaaaauccucgaaauaucaggacaugaaucaauuaauuucaagaaaucggcggaugaaauaguugaacaaguaaaaacaauauucucagcacucggauggaacacagaaguauuaugcuuugauagugaaaaagaacuagauaaacaacccuacuucaaacuauggcaucuauuauauucguucgaaggagauuccacuccaacgggugauggaaauuuaauacagaaaaucgccgacuuaugcggguucgagaaagacuaugcuucaaucuuagcaaacauaacguuccaggaggauuauggaucacuaaguacuaaagcaauaagaaaaauccugccacauuuaaaagacggaaaccaauaugacguagcgugcgaauacgcuggcuacaaacacagcaaaucaagccucaagaaagaagaaaucaaaaacaaaguacuaaaagacaaacuagaacuacuacccaaaaacucacucagaaacccagucguagagaaaaucuuaaaccaaaugguaaacgucauaaacgcaaucaucaccacauauggaaaaccagacgaaauaagaauagaacuagcaagagagcuaaagaagaacgcuaaggagagagaagaacucaccaaaaguauuguugacacuacaaagacacacgaagguauacgagcaauacuacaaaaugauuuugguaugagccauguuagcaggaaugcaaucauaagguauaaacuauaugaagaacuaaaagacaauggauacaaaacucuauauaguaauaccuacauaccgaaagaaaaacuauucuccaaagauuuugauauagagcauauuaucccacaggcaagacucuucgaugacucauuuucaaacaaaacacuagaagugaaaucaauaaauauagagaaaggaucgaagaccgcauaugacuuuguggaagaaaaauauggagaacaaggcuuacaagaauaucucaauagaugugaagugcuauuccgagacaagaaaacaaaacugcgaaaguuaaagaugcaggagagugaaauuccagaaggcuucauagaccgagaucuacgaaacacacaguauauugccaagaaagcgcuuagcaugcugaacgaaauaugcagaagaguaguagcaacaacuggagcaauuacggaugaacuacgcgaagacuggcaacucguagaugucaugaaagaacuuaacugggaaaaauauaaggucuuaggucuaguugaauauuuugaggauaacgauggaaggcuaaucgggcguauaaaagauuggacaaaacgaaacgaccauagacaucaugccauggacgcauuaacaguugcauucacaaaagauguguuuauacaauacuucaauaauaaaaacgcaagucucaaaccagauacuaacgaagcagccauaaggaacaaguacuuccaaaaugguaaagccaucccaccaaugagcuuagaugaauuuagagccgaagccaagaaacacuuaaaugacacacuuaucucaauaaaaacuaaaaacaaaguugucacaauaaaccuaaaccggaccaagaagaaaaauggaauaaauaaaaagcaacaacaaacaccaagaggacaguuacaccuagaaacaguauauggcagucacaaacaguauguuguaaaagaagaaaaagucaaugcaucauuugacgcagcaaaaauugcaacaguaaauaaaccagcauauagggaugcauuauugagaagacuucaagaaaacggcaacgacuccaagaaagcauucacaggaaagaacagccucgauaaacaaccaguauggcucgaugccaaacagaacgaaugcguacccgaaaaagucaaaacuguaaugcuagagacaguguacacaguaagaaaaccgauagaugagaagcucaacguagauaaaguggucgaugccagaauaagaaaacuucuucaagauaggauaaaagaauacggaaacgccaaaagcgcauuugcaaauuuagaugagaacccaaucuggcuaaauaaagaaaaaggcauaacaauaaagaggguauccguaucaggaauaaguaaagcacaaucuuuacaugaaaagaaagacaaagacggcaauuucauacuugacaaagauagcagaagaauaccaguggacuucguaaacacugggaacaaucaccacguagcgauauauagaaaaccaguauuagacaagaaaggacaagccguguucgaugaaaauggcgaacuaaaauuugaauuagaggaaguaguagucaguuucuuugaugcaguuacacgaguaaaccucucucaacccauuauagacaaagacuacaaacggucagaaggcuggaaauucuuauuuucaaugaaacaaaacgaauauuucguauucccuaaugagaaaacuggauuugaucccaaagaaauagaucuccugaaccccgagaacuaugcgcucauaaguccaaacuuauucagaguacaaaagauagccucaaaggacuauguauuuagacaccaccuugaaacaguagucgccgaucggaaagaacuacaggaaaucacuuggaaaagaauaucgucgcuaucaauccuaaacagaauaauaaaaguaagaguaaaccauauaggucaaauaguaaugauaggagaauacuga

SEQ ID NO: 9140 - RNA, 4284 nt, Artificial Sequence
  Cas9 variant
auggcuaagccaaaagauuauaccaucggauuagacauaggcacaaauucaguuggauggguuguaacugacgaucaaaacaauauauuaagaauaaaagguaagaaagcuauuggcgcuaggcuauuugcagaaggaaaagucgcagcagaaagaaggaguuucagaacaacaagaagacgucucagucgcaggcgcuggagaauuaaauuacuagaagaauuauuugacaaagagauagcuaaaguagacccuucauuuuucgcuagacuucaugaaagcuggaucaguccaaaagauaaaagaaaacgauauagugcuauagucuucccaagccccgaagaagacaaaaaauuccaugaaagcuauccaacaauuuaucauuugcgggacaaauuaaugaaagacgaccaaaaacaugauaucagagaaauauacauagcaguccaucaaaugauaaaagcucguggaaacuuucuacacgaugaaagcgucgaaacauaucggaguggcaugucuucauuaggaggucgaagugaacguacuauacuaucaguccaaacauuagaagagcuuaaugauuuauuugcagaaaaugaggggacagaagaagcaaaacuaaacguagcaucagcagagcagauaaacgauauacugaccgguggacacuuaaaugcugacucacagaaagaaauagggaauuuacuuuuaccuucaucauuuccgagcuucgaugacaaagcaaaagaaaaacaaguaaaaaaguuaaucaaaaauguugcgacuaauaucuccaaggcauggcuaggguacaaagcagacuucucuacaauauuaaaccucgcaaacgucgacaaagaccaaaagaaaaucuucgcauucgcacuacagggaggagacgaagaagacaaaguacaagaacuagaauccuuauuagaacaaucacaaacagacauaguagacaggcuaauagaaauucgucaugcaaucguauuauccgaaauuguaccaguaggaaugacacuuucagaagcaaugauagacaaauacgaucaacacaaggaagaccuuauaacuuuaaaagcgguuaucagaaauacaaaagacaaaaaaaaagcagcuaaauuacaagcaauauacgacuuauauguaaacaaucgacacgcagacuuagcaaaagcaaugaaacugaccggcauaaaaaaaaggucugaacucuuggaccccgaagagcuaaaaaaagcaaucucaagucuacuagacgacucaccagaagcugucgaaauaaaacaaauguuagaagaaaaaacuuuuuuaccgcuucaacguucaaauaacaauggcguaauaccaaaucaguuacaucaaguggaauuagaugaaauaauaaaaaagcagaguaaauacuacccauuccuggcagaaaaaaacccagaugaaucagaggaggcucaaaaaaaagcccccacaaaauuagaugcguuauuaacauucagaguaccuuacuauguagguccaaugauaacaaaagaagaacaagaagcgcaagacggccacuccuuugcguggauggugcgucgagauccacaagaccacgaagcuauuaccccauggaauuuugaaaagaagguugauaaaauggcaucagcuacucaauucauuaaacguaugacuacaaaagacaccuaucuacuaggagaagacguccuaccagcaagcucuuuaaaauaucaacucuuuacuguuuuaaaugaacugaacaaccucagagucaacggaaaaaaauuaaccucagacgaaaaagaacagguuauagagggauuauuuaaaaaacagaaaacaguaaaggcagacaaauucguaaaauacuggcaagcgaaacauaucggagcagauauaaagguuaaaggccucucagauccaaguaaauuuaacuccacaaugucgacauacauagauuucaaaaaaauauuuggagaucaacuaaacgacguaaaucgacaaaaugacuuugaaaaaauaauagaguacaguacgauauuugaagauaggaaaauacuagaagauaaauuacgcgccgauuucgcauggcuaucagaagagcaaaucaaacaacuauguaggcuuagauuacaaggaugggguagguuauccgacaaacuacuaacuagguugacagaugccgauggucagaacgucuuggaaagauuauggaauagcaacgacaauuuuguacagauuguaucagacccaaacaucaaagcuaaaauagaacaagaaaaccaaaaacuacuacgagaugggcaaagcgacgaugcuguagaaucaauacucgaugacgcauacacaucaccacaaaauaaaaaagcaauacgucaagucaugcguguaguacacgauauagugaaagcaugcgacgguaacgugccggcuaaauuugcuauugaguuugcaagaagccaagaagaugaucccaaacgaaccacggcaagaguuaaccaaaugcaaaaaauuuaugaccaaaucucagaugaaguaguaucacagggugugaaggaacaacuuucugguaugaaaucuuugaaagacagauauuaccucuacuuuaugcaaggugggcgagaugcauauacgggugccaagcuaaauauugacagauugucggauuacgacauagaucacaucaugccccaaaguuucgucaaagacgauagccuagauaauagggugcuaguugcaagagcagucaauaaucaaaaaucagauaaagucccagcauuacuuuucgggaauaaagugguugcagacuuggguauaacaguaagagaaaugugggacaaguggcaaaaauuaggcaugauauccaaacggaagcuaucuaauuuacuaacagauccagaugcuuuaacagaguauagagcacagggauucauccggcgucaguuaguugaaacaagccaagugauaaaauuaaccgccaccauucuccaauccgaauucccagacucuaaaauaauagaaguaccggcaaaauacaacucaaucguucgaaaacaguucgaccucuauaaaaguagagaagucaaugauuaucaucaugcaauagaugcauaccuuaguacaauaguaggcaacuaucucuaccaaguguacccaaaccuacgacgcauguucguguauggcgaauucaaaaaauucuccaguaacgcugaagaaucggcauaugacgugguacgucggguaaaaucuaugaauuuccucgacgaucuauugagaggcacucauggagauaauauuuacuguagaucaaccggagaaauaguauucaacagaaacgauauaauaaguaaacugaaacaggcauacucauucaaacaaaugcuagugacccaagaagucuucaccaaaaaaagcgcucuauuugaccaaacaguauacccaucaccagaaagagauucaaaaaaaagaucaggacuaauuccacguaaaaaaggaauggacacagaaauuuacgggggguauucuggaaacaaagaugcauauuucguauuagcugaggcuguaaaagaaaaaggucauacauuacaaauuguaggcguaccaauucgagcauuaaacacauuaaaaaacucagccaauuauucggaaaagcuauuagaaauuauuaaaccccaaguaauguuuaauaaggacacagguaaaccaaucaaaggaauuaaagacguaaaaauuuuaauggacaaaauuccaugccgacagccaguacuagaaggugaaucauacuacaugcuagcuucuaguaaauauagauauucccuaaaacaaaucagcuuaucacaaaugucgaugaaauauauacucgauuauauugacgaucccaacuuuaacaaacaugaaaugauaaauauagaccaacaagaugagaaagaaugcuuguuaagcguguacgaugaaauacuagaaaaaauggacaaauauuuaccucuauucgacauuagguccuucaggaagaaauuacaugacgguagggacgcuuucauagcacuaccugucgcguccgaagaaaaaaaaccagguaaagucgaugugauaagaaaaguccuaaaaggccuucaugcuaacgcagacauaacuaauuuggccgaacuuggauuuggcacugcagcccuaggcgcucucguaaguacaggaggaauuaagauaucggacgacgcaguuuuuauuuaucaaucaccaaccggacuguucgaaagacguguaaaaguaucggacuuacuaaaauga

SEQ ID NO: 9141 - RNA, 4287 nt, Artificial Sequence
  Cas9 variant
augaagaaaauccuagguuuagauuuagguaccacaaguaucggaucagcauacguguuggaagcagaaaaauccgcagagcaaacaaaaauaguauaucucgguacccgaauaauacucuccucagccgaugcagagaacuuuucuaaaggauuaaguugcuccccgacuaccgauagaacguucaagcguucuaugcgaagaagacuccaacguuauaaacaaaggcgaucaucgcuaauacaacaguuuaagaaaauuggaauaauuaccaauacugaacaaauaauaagagaaccuauauccgaaacacaugaacuacucaggauucguuccaaagcaguaagcgaacgaguaucucucgaagaguucgccagaauacuccugacaauaaacaaacgcagaggauacaaaucaaauagaaaaacuagcaaaucuaccgaagaagauggaaaauuagucgaugcuauggcuguaacaaaagaacuaauaaagcucaagaaaacccccggccaauauauguucgaacgauucaaaagggguaaauaugcagaaauagacuucuacccguuugaucuuauuaacgaauuaaaacaaauaugggaaguccaaggacaaaaauauccugauguuuuaacugaagaccucuuaucaucacuucuuaaacagaaaacaggaaaagcaaaagaacucauauauagcaaaucagauuuaaacccagcagaaguaccaaucgauuaucaaaaaggcaaaaaguuaagaaaaacaauuuuaaacaaauacuuugcguaugaaucuagaagccucgcagccaccaacauuauaccagucgaacaaguuauuacggcaauaguagccauaugcaaacaaauaaauaauucaucaggauaucuuggcgcaauaggagauagaucacgaguucuuuacgcgaacaaccaaacuauaggccaguacuuauaugaaagaauaaaagcaaacccacaugacagaauacgaggcgaaguauucuacagacaagacuaucuagacgaauuugauagaauaugggaaugccaacaaaacuauuauccagcaaucuuaaccaacgauagaaaacaguuuauacgaaaccgaauaauauucuaucagaggccauuaaaauccaagaaaagcgaacuugccuuuugugaguucgaauccagagaaguagaacacaauggcaagaaauauacagaaggacuacaugucgcgccaaaaaguucaccaguuuuucaacacuuccgcuuauggcaaagauugggacaaauagaaguuucuccacuacggaaauggaacaaacaaagcaaugaacuauucgaacaacaaaacgacacugaccaagaaagaauacuaaacacggaagcaaaacaaaaacuguuuucauaucuaaauuugcuagaccaucucaccgauaaugaaauucugaauauucugggauacuccccugacaaauggaaaauuaauuucagagaaauaauaggcaacagaacgaauaacucaaugaugaaagcauuuuucaacaugaaagagaugacugauggugaacaaauuaauugggagaaaaaccuaaccaaaauuaccaauggccaaucauuaauaucacccgaacaaaucguggacuugauccgacaauucuucgagagagaaggaauuacaacaagucuucuauacuuugacccuacgacagauaacuucagagaacaaucgcauuacucauuauggcaccuacuauacaguuacgaagaugacaacagcccuacagguacgacaucacuauguaaaacacucgccaaaagauacgguauaccacaugaacuaugcccgcuacuagccucguuaacauuugagccucaauauggaucuuuaucaacaaaagccaugagaaaaauucucccuuuuaugcaggaaaaugguuacgacaaggcuugugaacucgcagguuacagacauucagcuuggaccaccaaagaagaaaacacugagagaacucuaaagaacucauuaccacuucugagaaaaggaucucuaagaaacccagucguagagaaaauacuaaaccagaugacucacguaauaaauacacacauaucugaauacggcaaucccgaugaaauaagaauagaaauggcacgugacaugcaagccaacucuaaacaaagaaaagccaugacaaccgccauagcagaagcaacgaaacgaaacacccaauucaucgaagaaauucaaaaagaauuuggauucaauccaagcaaaaacgaccuuauaaaauacaaauuauggaaagaacucgcaccauuaggaucaaagacacucuauucaaauacuuacaucccuaaagaggaauuauuuacugcaaaauucgaaauagagcauauuauaccucgagcauuauucuacgaugacagcuucucaaauaaaacccucgaacuaaauucuguaaacaaacuuaaaggaaacaaaacagcacuagauuacauggauacacuaagucaagaacaggcaaacgauuacauuauuagaguugaagaacuaaagaaaaucggagcaauaacacaagcaaaauauaagaaauuacuaauaagggagaaagacuuaggugacgacuucacaaauagagaucucaccaacaccagauacaucaucaggcacgcagcagacaugcuacuucaagucacuccuucaaucguccacacuaacgguaguauaacggcgauacuaagaagagacugggagcuacucgacauauuaaaagaacuaaaucuucccacauacgaauccauagaucgaaaaauauccgacccgaaggaaaaacuaacugaaucuguggaaagaaaagacggacaagccauaaaaaugauaaaagacugguccaaaagagacgaccaucgacaccaugcaauggacgcuuugauaacugcacucaccacccgcaaacacguccaauaucuaaacgguaaccgaggggcagaagaaacagacaaaguucaaaaacuucaacaacuaaaagcucuacguaaacagcuaaucggauccgacggccauuucauaccaccaaugcaugacauaagggugcaagcaaaggaagcucugagccgugucaucauaagcacgaaagccaagggaaaaguaacaaccccaaauaccaauauuauaugcucaagagacaagacgacagggcgaaaaauauacgucaaacagacaacccuaacaccccguggggcguuacacaaagaaaugcaauauggcuguaaccauuacuaucuagaaaaacaaaucccaauagguucuaaacuaaccgaagaagaaaucagacuuguaagcucacccaaaauuagaucaauguuauccgaaagacuccaagcauauaacaacgaccccaaaucagcguuuacuggcagaaauucaauggauaagaaaccacucgaagauaaaaauaagaaauuaguauauaccgacaagaaaguaaaacaaaccauacuggcaaaccguuucguaaaacgcgaucggguaaacucgaaacuugaccuagacaaaguaaucgauacaggcaucaaacgcauucuagagagacgucuuaaacaauacggaggaaaauacgaaaccgccuuuagugaccuugaaaauaauccuauaugguuaaacgaagaaaaaggaauugcaauaaaauccgugagaaucaggggcaaaaauaacaccauaacaauaagacaaacuaauacauguaggauaaaauauguggcaaacgacaacaaccaccauuuagcaguauaugcccuacccgacggauccauagaggaugauauagugucuuucuucgacgcaguugaacgaucuagaaaaggacucccaauaaucgauaaacacaaaaaucaaucacuaggcuggaaauuuuuauuuucaguuaaacaaaacgaguacuuucuuuuaccgcagcaaggcgagaaaauagacauagauacaggagagauaagcaugcagacaacauuuucaccuaaagacuuaaguccagaauauauuaugaaccccgacaacuaugccgaauuagcgccacacaucuuuagaguacaaagcauaucaaaaacgccacaagguaaccgagacguaagaauauaccuguuuaaacaacaauacauuuccggaucccagaaagauucccugcaccuaaaaggaauaacgcaucggcaaauaucaucagccaaagaccuagcaggauuagugaagauacgaguuaaucaucuaggacgcauuguagcagucggagaaaaauga

SEQ ID NO: 9142 - RNA, 4287 nt, Artificial Sequence
  Cas9 variant
augaagaagauacuaggucucgacuuaggcacagcuucaaucggaucagccuaugugcuugaagcagaaaaaucugcagaccaaaccaaaaucgucuaccuugguaccagaauaauacuaucaucagcagacgcagagaacuucucuaaaggcuuaucaugcucgccaaccacagacaggacuuucaaaagaagcaugagacgccgacuacaacgauacaaacaaagaagaucuucucuuauucaacaauucaagaaaauaggaauaaucacuaauacugaacaaauaauaagggaaccaauaucagagacacacgaauuacuacguauaagaagcaaagcagucucagagaggguaagucuagaggaguucgcaagaaucuuacucacaauaaauaaaagaagagguuauaaaagcaacagaaaaaccucuaaaucuaccgaagaagacggaaaauuagucgacgcaauggcaguuacaaaagaauuaauaaaacucaagaaaacacccggacaauacauguuugaaagauucaaacgagguaaauacgcugaaauagauuuuuauccauuugaucuuauaaacgaacucaaacaaauaugggaaguacagggccaaaaauauccugaugucuuaacugaagaucucuuaucaucacuauuaaaacagaaaacagggaaagcaaaagaacuuaucuauucuaaaagcgauuugaauccugcagaaguaccgauagacuaucaaaaaggcaagaaacugagaaaaacaauauuaaauaaauacuucgcauacgaaucacgaucucucgcaguaacaaauaucauaccuguagaacaagccauaaccgcgaucguagcuauaugcaaacaaaucaauaacucaucaggcuaucuuggagcaaucggagaccguucacguguauuauaugcaaauaaucaaacaauaggacaguaucuauaugagagaauuaaagcuaacccccaugaccggauaagaggagagguauuuuauagacaggacuaccucgaugaauuugauagaaucugggaaugucagcaaaacuauuacccagccauccucaccaaugaucgaaaacaauauauaagaaacaggauaauauuuuaccaaagacccuuaaaauccaagaaaucagaacuugcauucugugaguucgaaaguagagaaguggaacauaacggaaagaaauauacagaaggacuacacguagcaccgaaaucgucaccaguauuucaacauuuccgacuauggcaacgauuaggacaaaucgaggucuccccacuuagaaaaugggauaaacaaaguaacgaacuauuugaacaacaaaacaaugcagauagagaaggcauccuaaauacagaagcaaaacaaaaauuauucucuuacuugaaccucuuagaccacuuaaccgauaacgaaauacuaaauauccuuggauauagcccagacaaauggaaaauuaacuuuagagaaauaaucggcaaccgaacaaacaauuuaaugaugaaagccuucuuuaguaugaaagaaaugacagauggagaacagauagauugggagaaaaaccuaacaaaaauuacuaacggccaaucacucauaucaccugaacaaauuguagacuuaaucagacaauucuucgaaagagaaggcauuacuacuucacuacucuauuucgacccagcgaccgacaauuucagagaacaaagccauuauucacucuggcaccuacucuauagcuacgaagacgacaauucacccaccggcaccacaagucuauguaaaacucuugcaaaaagauauggcaucccacaugaauugugcccacuacuagccagccucacuuucgaacgacaguauggaucccucuccacaaaagccaugagaaaacuacuaccauuuaugcaagagaaaagauaugacgaagcaugcgaauuagcuggcuauagacacagcgccuggauuacaaaggaagaaaacgcaaaaagaacucuaaagaacaaauuacccuuacuuaggaaaggaucacuucgaaacccagucguagagaaaauccuuaaccaaaugacacacguaaucaacacucacaucgcugaauacggaaacccggacgaaauacgaauugaaauggcacgagacaugcaggcaaauagcaaacaaagaaaagcgaugacggcagcuauaacugaagcaacaaaacgaaacacacaauucaucgaagaaauacaaaaagaguucggauucaauccaucuaaaaaugacuuaauaaaauacaaacuuuggaaagaacuagcaccuuuaggcaacaaaacacucuauucaaacauauacauccccaaagaagaauuauuuaccgccaaauucgaaauagaacacauuauaccuagggcauuauuuuacgacgacuccuucucaaauaaaacucucgaauuaaacagcguaaacaaacuaaaaggaaauaaaacugcuuuagauuacuuagauacacugggccaagaaaaagcaaacgacuacauccuacgaguagaagaauuaaagaaaaucggcgcaauaacucaagcaaaauauaagaaauuacuaauacgagaaaaagacuuaggagaugacuucaccaaccgagaccucacaaacacgagauauauaaucagacacgcagccgacaugcuacuacaaguaacacccucaauagugcauacuaacgguagcauuacagcgauacuccgacgggauuggggccucuuagauauuuuaaaagaauuaaaccuaccaacauaugaauccauagauagaaaaaucuccgauccagaagaaaaacucacccaaucagucgacagaaaagacggacaagcaauaaagaugauaaaggacuggaguaaaagagaugaucacaggcaucacgccauggacgcuuuaauaacagcccucacgaccagaaaacauguacaguaccucaacgguaacagcggagccgaagaaaccgauaaggcacagaaauuggaacaacuuaaggcuuuacgaaaacaacuaauaggcucagacggacacuucauaccacccaugcaugacauacgaguccaagcgaaagaagcucuaaguagggucauaauaucaacaaaagucaaaggaaaaguaacuacucccaauacaaacauaaucuguucaagagacaaaacaacagguagaaaaauauacguacgccaaaccacccuuacgccacgcggagcacuccaucuagauacuaaauacggaauuaaccguuauuaucaagaaagagaggugucaauagggucaaaauuaacucaagaagagauaaggcuagugucaucaccccacauccaaagcauacuacuugaaagacuaagagccuucgauaacaaccccaaaagcgccuucaccggacgaaauuccgucgauaagaaacccuuagaggauaaaaauaagaaauuaguauacacagacaagaaagucaaacaaacaauuuuagcgaaucgauuuguaaaaagagaucaaguuaauucaaaacucaaccuagauaaagucauagauaccggaauuaaaagaaucuuggaaggccgccuacaacaauacgguggcaaauaugaaacagcauucucugaucucgaaaacaauccaauaugguuaaaugaagaaaaaggcauagcaauuaaaucagugcgcauccgcgguaaaaacaacgccaucccaauacaccaaacagauacuuguccaauagacuaugucgccaacgauaacaaccaucaucuagcgguauacguauuaccagacgguacaauagaagacgauauaguaacauucuuugacgcagucgaacguagucgacaagggcuacccauugucgacaaaaacaaaaaccaaucauuagguuggaaauuucucuuuagcauaaaacaaaacgaauacuuucucuuaccucaacaggcugagaaaauagacauagacacaggugaaauuagcacucaaacaacauucagcccaaaagaccuaagcccugaauauauaaugaacccagauaauuaugcagaacuagcaucacauauuuuucgaguucaaagcaucucaaaaacgccccaagggaacagagaugugagaaucuacuuauucaaacagcaauacaucucaggaucacaaaaggauagcuuacaccuuaaaggaauuacauacagacaaaucaguucugcaaaagauuuagcagagcuagucaaaauacgaguaaaucauuuaggucguaucguauccguuggagaaaaguga

SEQ ID NO: 9143 - RNA, 4287 nt, Artificial Sequence
  Cas9 variant
augaccaaaaaaauccuaggacuagaucugggaaccacaucaauuggaugggcguaugugaucgaaagugauaaucccgaugaaucagaaauaaaacaaauaggcguuagggucaauccucuuacaacagacgaacaaacaaacuucgaaaaaggaaaaccauucagcauaaacaaagaacgaacccucaaacgaggagcacguagaaaucucgaucgauacaaagauaggcgaaacaaucuaauagaaguguuaaaaaaagcgaacauauuaagucaagacucaaucuuaaccgaggagggucaacacacgacucaccaaacuuggcaacucagagcaaaagccgccguugacaaaauagaaaaagaagaauuggcccgaguauuacucgcgauaaacaaaaaaagagguuauaaaucaucccggaaggcgaaaaacgaagaugaaggucaagcaauagauggaauggccguagcuaaaagauuauacgacgaacaaauuacaugcggacaacuaguuuaccaacuacuaagagaagggaaaaaauccauaccugauuuuuacagauccgaccuacaagccgaauuugauaaagucuggaacuuccagaaacaauucuaucccaaaaucuuaaccgaugaauuuuauaaagaacuuaaggggaaaggucaacgcgcaacuagugcucucuuuuacaaaacauauaauuucaauacugcagaaaacaaaggaagccgcgaggaaaaaaaaauucaagcauauaaauggagaagugaagcaauaagccagcaacuggagaaagaggaaguagcguuuguacucacagaaaucaacaauaaucuuaauaacuccucuggauacuuaggcgcaauaagugacagaagcaaagaacuauauuucaacaaacaaacagucggucaauauuuauaccaacaacuacaagagaauagacaugcaagacuaaaaaaccaaguauuuuacagacaagacuacuuagacgaauucgaagcuauuuggaaagaacaagcgaagcaccauacugagcuaacagaagagcucaaagcagaaauucgagacaucauaaucuucuaucaacgaaaacucaaaucacaaaagggacuuauaagcuucugugaauuugaaaguagagaaauccaaauugauggcaaaaaaaaaacaauaggauuaagaguagcgccgaaaaguagcccuuuauuccaggaauucaagauauggcaaaacuuaaauaauguucucguuagaaaaaaaggcaguagaaaaaggaacguaaaacaagaaauacaaggaucacucuucgaagaggaaaaagaaaucuuuguauucgauuuagaaacaaaagaaaaauuauucgaagaacucaaccuuaaagggaaccugagugcaaacaaaguaauagaacuccucggccauaaacccacagaaugggaaauaaacuauucagcguuagaaggaaaucguacaaaucaagcccuauacaacgcauaccuaaaaauacuagauauagaaggauaugaugaagacuugcuaaaauuaagugauaaagaugauaucaacgucgcagaccugaaaacuccagcaucagaaauaaaaaauauggucagagauauauuccaaguauuaggcaucaguacugauauuuuagaauuugacgcagaauuagacggaaaagacuucgaacaacaagcaagcuaccaacuauggcacuuacuauauagcuaugaaggcgaugauucccaaucaggaaacgaaaaacuguaugagcugcucgagaagaaauuuggauucaaaaaagaacauucacaaguacuagcaaauguaacauuauccgaugacuaugguaaucuaagcucgaaagcaaugaggaaaauuuaccccuucauaaaggaaaacaacuauaguacugcuugugaauuagcaggguacaggcacucaaaacacucucuaacaaaagaggaaauagaaaacagaccacuagaugauaaauuagaacugcuaaaaaaaaauucauuaagacaaccuguagucgaaaaaauacugaaucaaaugguaaacguaguaaauucucuacuagaaaaaaaucgaaaagaaaacccugacuuuagauucgaugaaauaagaauagaacuagcucgcgaacucaagaaaaaugccaaagaacgagcagagaugacaacaaacauuaacuccgcaaaaacugaaaacgaaaagauuuuuaaguuacugcaagcagaauuuggacucaaaaaccccacucgaaaugacauuaucagguauagacuauaugaagaacugaaaaauaacgguuauaaagaccuauacaccaacaaauauauaccacgugaaauacuuuucucgaaacaagucgacauagaacacaucauuccccagagcagguuguuugacgauagcuucagcaacaaaacaauaguauaccgagaaacaaaccuagauaaggggaaccaaaccgcauucgauuauauagauaguaaauauggaaaugaaaaggucgaagaauauauacucagaauagaagcucuccaugacgcauggaaaaagaauaaagaagaagguauaucaaaagcaaaauaucaaaagcugcuuaaaaaagaaacagaaauuggugacgguuuuauagaaagagaccucagggaaucucaauacauagcuaaaaaagccaaagaaauguuauuuaaaauaacgcgaagcguaguaaguaccagcgguucaauaacagauaaacuccgugaagauuggggccucaucaacauuaugaaagaacuaaaccuaccaaaauauagaagccuaggauuaacggaaaugcaagaaagaaaauuuggacaaaaaguagaggucaucaacgauuggaccaaaagaaaugaucaccggcaccaugccauggaugcacuaacuguggcauuuacuaaacauaaucacauacaauauuuaaauuaccuaaaugcacguaaaaacgagaaucauaaauuacauaauaauauaauagcaauagagaaucuagaaacggaaacgaugaucgacaacaacggaucuaaaaggagggucuucaaggcaccgaugccuaauuuuagacaaguugcuaaagaacaccuggaaaacguauuaauaucacacaaagccaaaaauaaaguagucacaaagaacaaaaauaaaaucgcaggaaaaguggcugcacaagaaacccucacaccacgaggacaacuucacaaagaaacaguauacggaaaauaccaguauuacgucaacaaagaagaaaaaaucggaacaaaauuugacgaggaaacaauaaauaaaguuagcaacccgcaauacagaaaacuccuauuagaaagguuauccgccaacggaaacgauccaaaaaaagcauucaguggcaaaaacgcgcuaucaaagaaccccauauaucuaaacgagacuaaaacagagacuguuccggaaguugucaaacuaacaugguuagaagaagauuacuccaucagaaaagauauaacuccagacaauuuuaaagacgaaaaauccaucgacaaaauacuggaugaaggcguuaaaagaauacucaaaaaaagacuacgaaaaaacgauaaugacccaaaaaaggcauuuagcgaccucgacaaaaacccuauauggcuaaacgaagaaaaagguauauccauaaaaagaguuacaauaucagguguaaacaacgcagaaccccuccauuauaaaaaagaucacuuuggcaacgacauccuggaugaaaaaggggacaaaauaccaguugauuuuguaucaacuggaaauaaucaucacguagcgguguauagggaugaaaaaggaaaucuccaagagaauauaguauccuucuucgaagcaguaauaagggucaaccaaggcuuaccgauaauugacaaagccuacaaccaacaccuuggguggcaauuccuauucacaaugaagcaaaacgaaauguuuguguucccaaacgaaaaaucuggcuucaauccacaagagauagaccuacuagauccauccaacaaaaaaaaaauaucaccgaauuuguuccgagugcaaaagaugaguaaagugauuuaugguaacaguccuguaagagaauacguauucagacaccacuuagaaaccaacguugaugagaagaaagagcuaaaagacauaacauucaaaaacauaaaaagccugggauacuuugaagacauaguuaaaguacgaaucaaccaccuaggagauauaguaucaguaggagaauauuga

SEQ ID NO: 9144 - RNA, 4293 nt, Artificial Sequence
  Cas9 variant
augaaacacauacuaggauuagacuuggguacaaacucaauaggaugggcaguuguaaaagaagcacaaaacgauaacgaacaaucagaaauagucgauguugggguaagagugaacccacucacaacagaugagaaaacuaauuucgaaaaaggaaaaccgauaagcacaaaugcggauagaacauuaaaacgaagcgcacggagaaaccuucagagauacaaauuaagacgaaaagaauuaauugaacucuuaaaagaacaccaacuuauuagcacagacacaauacucacagaaaauggaaaaggaaccacauuccaaacacuagaacuaagagcaaaaagcgcaaaagagaaaauaucgcuagaagaacucgcaagaguauuccucacuaucaauaagaaaagaggcuauaaaucuucacgaaaagcuaaaaaugaagaugaaggacagcugauagauggaauggaaauugcaaaaagacuauacgaagaaaaucuaacuacaggacaauuaucauuacaguuguuaaaagaaggcaagaaauccuuaccagacuauuacaggucagaucuucaauuugaacuagacaaagucuggaauuuccaaaaacaauuucauucagacauuuuaacagaugaauuuuaugcacaacuuaaaggaaaaggacaacgagcaacgagcgcacuuuuccuagcaaaauaucaaauauacacugcugaaaauaaaggaucaagagaagacaagaaauuacaagcauaucaauggagaguagacgcacuaagcaaagaacuaacaagggaacaacuggcauucguaauaacagaaauaaauaacaacuuaaacaacucaaguggcuaccugggugcaauaucagauagaagcaaagaauuguauuucaacaaugaaacuguaggagaguaucuauggaaacagauagcugcaaauccucauacaaguuugaaaaaucaaguauuuuauagacaagauuaucuagacgaguucgaacaaauauggaaaacacaaucggcauucuaccccgaaauucucacagacgaacucaagaaagagcuaagagacguuguaaucuucuaccagcggaaacuaaaaucacaaaaaucauuaguuuccuuuugugaauuugaaaauaaagagauugagaucaagaaagaagauggaacauccacaaagaaagucauaggauuaaaagucgcaccgaaaagcucaccacuauuccaagaauuuaaaauuuggcaaaaccuaaauaacguauuaauuagaaagaaaggcaguaaaacgaagaaaguugccaaaaaccaacaggcgguucuuuucgaagaggagaaaacgauaucggaacuggaccuugaagcaaaacaagcucucuucaaugagcuaaaucuaaaagggaaucuaaaagcagauuacuguuuagaaauacuagguuauucuccaaaagaaugggaaaugaacuauucaguauuagaagguaacagaacaaacaaagcauuauaugaagcauaccucaaaaucacagaucuagaagguuaugacgccaaaaaccaccuaaaagucaaacuaaauaaagacgaggucgaauuagaugaccuaaaaguuccugcauccgagauaaaagauauggugcaagcuauauucaaagaagcgggaauaaacacagacauauuacauuucaaugcagaacuugacggaaaagacuucgaaaaccaagcaucauaucaacuauggcaccuccuguacucauaugagggcgacgauagcaaaucuggaaacgaauuacuauauaaacuccuugaaacaaaauuugguuucaagaaagaauaugcccaaauauuagcuaacguuagcuuauccgacgauuacggaucucuaagcacaaaagcaaugcggaaaauccaucccuacauaaaagagaacaaauuuucaacugcgugcgaacuagcuggcuauagacauucgaaacauucguuaaccaaagaagaaaacgauaacagaguauugaaagauucucuagaaguacucaagaaaaacagccuacgacaaccaguaguagagaaaauccucaaucaaaugauaaaucuaguuaaugcacuacugaagaaauaucgaacagaaaacccaaauuucaaauuugaugaaauaagaauagaacuagcaagagaacucaagaaaaacgcagaagaacgagcaaacaugacugccaacauaaauaaagccaaaaccgaacaugagaaaaucauaaaaauacuuaaaaaugaguucggacuaccaaauccgacuagaaaugacauuaucagauauagauuauacgaagaacuaaaagccaauggauauaaagaccuuuauaccaauaucaaaaucccacaagaaaaacuauuuacuaaagaaauugauaucgaacacaucauacccaaaucaaggguauucgaugauaguuucucaaacaaaacauuaucuuuuagaaaaacaaauuuggauaaaggcgaacguacugcauuugacuauauggagucaaaauuuggagcagauaaauuagaagaauauguagcaagaguagaagacuuauauaaaaauaauauaauaucuaaagcgaaauaccaaaaauugcuaaagaaagaaucugagauaggagacggcuucguagaaagggaucugcgagaaacacaauauauagcuaagaaagcaaaagagauucuucuacagauaacaccgaacguacuaucaaccucagguggcauuacagaccgcuugagagaagauugggaucuaauaaacgucaugaaggaauuaaaccucccaaaauauagagcgcuaggacuaacccaaauggaagacagaaaauauggacaacaagucgaaguaaucacagacuggacaaaacguaacgaccauagacaucaugcuauggaugccuuaacuguugcguucaccaaacacaaccauauccaauaccuaaacuaucuaaaugcuaggaaaaacgaaaaacauaaagaacacaguaauauuaugggaauacaacaauuagaaacaauaaaagucacagacaaaaacggaaacgagaaaagagucuuuaaagcaccaaugccgaacuuccgacaaguaacaaaagcauuucuugaaaacauccuaaucagucauaaagccaaaaauaaaguagucaccaaaaacaaaaacaaaguagccggaaguaacaaaguccaagaggugcuaacaccaagaggacaacuccauaaagaaaccguauacggaaaauaucaauacuacguacaaaaagaagagaaaauaggcgcuaaauucgauuuagaaaccauaaagaaagucgcuaacccauuguaccaaucauuauuaaagaaaaggcuagaagaaaauggaggugaccccaaaaaggcuuucacaggcaaaaauagcuuagccaaaaacccgauuuauuuagaugauacacaaacagaacaauuaccagaaaaaguaaagcuaguguggcuugaaaacaguuuuaguauuagaaaagacauaacaccggaaaauuuuaaagaugaaaaauuaauugacaaaauccucgacgagggugugaaaagaauuuuaaaagaaagauuacaaaguuucggcaaugacgccaagaaagcauucucugauuuagacaaaaacccgaucugguuaaacaaagaaaaaggcauuacaauuaagagaguuacuauaaguggaguagcaaacgcagaacccuuacacaccaagaaagaccaccuaggaaaagaaauacuagauaaagaagggaaaccaauaccagucgacuucauaagcacaggaucaaaucaccauguggcaguauacagagacgaaaagggcaaucugcaagaaaaaguagugagcguuuuugaagcagucguuagggcaaaucaaggauuaccaauaauugauaaaacuuauaaccaacaccuuggaugggaauuuuuauuuacaaugaaacaaaacgagauguucgucuuucccaacgaaagcacaggauucaacccaaaugacaucgacuuacuagaccccaaaaacaaaaggauuaucaguccaaauuuauucaggguccaaaaguucaguaaacugcaauacggaaauucauuuguaagagaguuuguuuuccgacaucacuuagaaacuacaguggaagauagaaaagaacuacaaggaauaacauacaaacaaaugaaaaauaguacauuuuucaacgauauuauaaaaguacgcauaaaucaccuaggagauauagugaguaucggcgaauauuga

SEQ ID NO: 9145 - RNA, 4293 nt, Artificial Sequence
  Cas9 variant
augaaacauauacuagguuuagaucuugguacuaauucaauaggaugggcuguuguuaaagaagcacaaaacgauaacgaacaauccgaaaucgucgacgucggaguaagaguaaauccacuuaccacagaugaaaagaccaacuucgaaaaaggcaaaccaauuucaacaaacgcagauagaacacuaaaacgaucagccaggcguaaucuucaaagguauaaacuaagacgaaaagaacuaauugaacuacucaaagaacaccaacucauaucuacagacacaauacuaacagaaaauggaaaaggcacuacauuccaaacccuagaacuaagagcuaaaucagcaaaagaaaaaauuucacuagaagaacuagcacgugucuuccuuacaauuaacaaaaagagggguuauaaaucaucaagaaaggccaaaaaugaagacgaaggccaauuaauugaugguauggaaauugcgaaaagacuuuaugaagaaaaccuaacaacaggacaauuaaguuuacaauuacugaaagaagggaaaaaaucgcuaccggacuacuacagaagugaucuccaguucgagcuagauaaaguuuggaauuuccagaaacaauuccacucucacauacucacagacgaauuuuacgcccaacuaaaaggcaaaggacaacgugcaaccuccgcacuauuccuagcaaaauaucagauuuacacagcagagaauaaagggaguagagaagauaaaaaacuccaagcauaccaauggcguguagaugcauuaagcaaagaguuaacacgcgaacaacuugcuuucgugaucacugaaauuaauaacaauuuaaacaauucgucaggauaucuaggagcaauaucagacagaaguaaagaauuauacuuuaauaacgaaacaguaggggaauauuuauggaaacaaauagcagcuaacccacacaccagccuaaaaaaucaaguguucuacagacaagauuaccuugaugaguucgaacaaauauggaaaacacaaucugcauucuacccagagauacuaacagacgaauuaaaaaaggaacuaagagacguaguuauauuuuaccaacgcaaguuaaaaucccaaaaaucguugguaaguuucugcgaauuugaaaauaaagaaauagaaaucaaaaaagaagacggcaccagcacgaaaaaaguaauaggacuaaaggucgcaccaaagaguaguccacuauuucaagaauuuaaaauauggcaaaaucuuaacaacguacucauacguaaaaaaggaucuaaaaccaaaaagguugauaaaaaucaacaagcugucuuauucgaagaagaaaaaacaauauucgaauuagacuuagaagccaaacaagcacuguuuaacgaacuuaaucuaaaaggaaaccuuaaagcauauuauugucuugagauacuuggauauagcccaaaggaaugggaaaugaauuauucaguucucgaagggaacaggaccaauaaagcauuauaugaagcuuacuuaaaaauaaccgaucuugagggauacgaugcaaaaaaccacuuaaaagucaaacuaaacaaggaugaaguagaacucgaugaucuuaaagucccagcaucugaaauaaaagauaugguacaagcaaucuuuaaagaagcuggaaucaacacugauauucuacacuuuaaugcagaauuagacggaaaagauuuugaaaaccaagcauccuaccaauuauggcauuuacuuuacagcuacgaaggagacgacucaaaaucaggcaacgaauuacucuacaaacugcuugaaacgaaauuuggauucaagaaagaauaugcacagauucuagccaacgugucacugagcgacgauuacggauccuuaucuacuaaagccaugcgcaaaauacacccauauaucaaagaaaacaaauucuccacugcaugugaauuagccggauacagacacuccaagcacucccuaacaaaggaagaaaacgauaacagaguucuaaaggauucucuagaaguauugaaaaagaacucacuacgacaaccaguagucgagaaaaucuuaaaucagaugauaaaccuaguaaacgcccuacuaaaaaaguacagaacagaaaacccaaauuuuaaauuugacgagauuagaauugaacuugcacgcgaacucaaaaaaaacgcagaagagcgggcaaacaugaccguaaacauuaauaaagcgaaaacagaacacgaaaaaaucauaaaaauuuuaaaaaacgaauucggacuaccaaacccuacacguaaugauauaauaagauacagauuauaugaagaauuaaaagcaaacggcuacaaagaccuauauacaaaugaauauauagaaaagcaagaccuauucaccaaaaacauugauaucgaacacaucauucccaaaagucgaguauucgaugacagcuuuucaaauaaaacccuaucuuucagaaaaacuaauuuagauaagggagaacgcacagcauucgacuacauagaaucaaaauucggugcagauaagcuagaggaauacgucgcaagaguagaagacuuauacaaaaauaacauaauuagcaaggcuaaauaccaaaaauuguuaaagaaggaaucagaaauaggcgacggguuuguugagagagaucucagggaaacucaauacauagcgaaaaaagccaaggagauuuuguuacaaauaaccccaaacguacuaucaaccaguggaggaaucacagaccgacuacgagaggacugggauuuaauaaacgugaugaaggagcuaaacuuacccaaguacagagcuuuaggucuaacacaaauggaagauaggaaauacggacaacaaguggaaguaaucauugauuggacuaaacgaaaugaccacagacaucaugcaauggacgcucucacaguagccuuuacaaagcauaaccauauacaauaccugaauuaucuaaaugcuagaaaaaacgaaaaacaccgugaacauuccaacauaaugggaauccaacaauuagaaaccaucaaagugaccgacaaaaacggcaaugagaaaagaguauucaaagcucccaugccaaacuuuagacaaguaacgaaagcuuuuuuagaaaauguccucauaagucauaaagcaaaaaauaaagucguaacuaaaaauaaaaacaaagucgcaggaucuaacaaaguacaagaaguuuuaacgccacguggccaauuacacaaagaaacaguauaugguaaauaccaauacuauguacaaaaagaagaaaaaaucggagggaaauuugaccucgaaacaauaaaaaaaguagcaaauccacucuaccagagccuacuaaagaaaagacuagaggaaaauggaggcgacccaaaaaaagcuuuuacaggaaaaaacaguuuagcgaaaaacccaauauaucuggaugacgcucaaacagaacagcuaccagaaaaagucaaacuugugugguuagaaaacaguuucuccauuagaaaagauaucaccccagaaaauuucaaagaugaaaaacucauugacaaaauucuggacgaaggcguaaaacgcauucuaaaagaacgauuacaguccuucgguaaugacgcaaaaaaagcguucucggacuuagauaaaaaccccauaugguuaaacaaagaaaaaggaauagcaauuaaaagaguugcaauaucaggcguagcaaaugcggaaccucuacacacuaaaaaagaccauuuagguaaagaaauuuuagauaaagaaggaaaaucaauaccuguugauuucauuucaaccggcaauaaucaccauguggcaguuuacagggaugaaaaaggaaaucuacaagaaaaagucgucucaguauuugaagcuguaguucgugcaaaccaaggucucccaauaauagauaaaacauacaaucaacaccuaggaugggaauucuuauuuacuaugaaacaaaaugaaauguuuguauucucaaaugaaucuacaggauuuaauccaaaugauauagaucuacuagacccuaaaaauaaaaaaauuauaucaccaaacuuguucagaguucaaaaauucaguaaacuacaauacggaaacagcuucguaagagaauucguuuuucgacaccaucuagaaacaacuguugaagaccgaaaggaauuacaaggcaucacauacaaacaaaugaaaaacucugcauucuuuaacgacauaauaaaaguacgaaucaaucauuuaggcggaaucguaucaguaggagaauacuga

SEQ ID NO: 9146 - RNA, 4293 nt, Artificial Sequence
  Cas9 variant
augaaagacauacuaggccuagacuuaggaacaaacagcaucgguugggcaguaguaaaagaagcacaaaaugauaacgaaacuuccgaaaucguagaucuuggaguccgcguaaaccccuuaacaaccgacgaaaaaacaaauuuugagaaaggcaagcccauaucaacaaaugcugauagaacauuaaaaagaucagcacguagaaaccugcaaagguauaaacugcgacgaaaagaacucauagaacuuuuaaaagaacaucaacuaauauccacagauacaauccuaacagagaacgguaaaggaacaucauuucaaacacuagaauuaagagcgaaaucugcaaaagaaaaaauaagccuagaagaauuagcgagaguauuucugacaaucaauaaaaaacgagguuacaaaucaucacguaaagcaaaaaaugaagacgaaggacaauuaauugauggaauggagaucgcaaaacgauuauacgaagaaaaccugaccacugggcaauuaagccuacaacuauuaaaggaaggcaaaaaaucacugccugauuauuauagaucagaccuucaauuugaacuagauaaaguauggaacuuccaaaagcaauuccauucgcacauacugaccgaugaauuuuacgcucaauuaaagggcaaaggccaaagagcgacgagugcacuauuccuugcaaaauaccagaucuacacugcagaaaauaaaggcaguagagaagacaaaaaacuucaggcauaucaauggagaguagaugcauuaucuaaagaacucaccagagaacaauuggcuuucgugauuaccgaaauaaacaacaaccuaaauaauaguucaggguaccuuggagcuauaucugacagaagcaaagaauuauacuucaacaaugaaaccguaggggaauaccucuggaaacaaauagcagcaaacccucacacgucccuaaaaaaccaaguuuucuaccgacaagauuaucuagacgaauucgaacaaauauggaacacacaagcccaauucuacccacagauacucacagaugaauuaaaaaaggaauuaagagauguagugauauuuuaccaacggaaauuaaaaucacaaaaaaguuuaguuaguuucugcgaauucgaaaauaaagaaauagaaaucaaaaaggaagacgguacaagcacuaaaaaagugauaggacuuaaaguagccccuaaguccucuccucuauuccaagaauucaaaauauggcaaaacuugaauaacguauuaauacgcaaaaaaggaucgaaaacaaaaaaggccgcaaaaaaccagcaagcagucuuguuugaagaagaaaaaacaauaucugaauuagaccucgaagcaaaacaagcauuguuuaaugaacuuaaucuaaagggaaaucuaaaagcagacuacugccucgaaauauuaggcuacucaccaaaagaaugggaaaugaauuacaguguguuagaaggaaacagaaccaauaaagcacuauacgaagcauacuugaaaauuacagaccuagaaggauaugacgcaaaaaaucaccuaaaaguaaaguuaaacaaagacgaagucgaauuagacgaccucaaagucccagcuucagaaauuaaagacaugguacaggcuaucuucaaagaagcagguaucaauacagacauccuccacuucaaugcagaacuugacggcaaagauuucgaaaaucaagcaagcuaccaacuauggcaccuauuguauucauaugagggagacgauagcaaauccggaaacgaacuccuauacaaacugcuggaaaccaaauucgguuucaaaaaagaauaugcucaaauacuagcaaacgucucuuuguccgacgacuauggaagucuaagcacaaaagcaaugagaaaaauacacccauacauaaaagaaaacaaauucaguacagcaugcgaauuagccggauacagacauaguaagcauagcuugacaaaagaagaaaacgacaacagaguacuuaaagauucauuagaaguacuaaaaaaaaacuccuuaagacagccaguuguagaaaaaauauugaaucaaaugauaaaccucguaaaugcacuacugaaaaaguauagaacagaaaaccccaacuucaaauuugaugaaaucagaauagagcucgcacgagaauuaaaaaaaaaugcugaagaaagagcaaauaugacugcaaacaucaacaaagcaaaaacagaacacgaaaaaauaaucaaaauacugaaaaacgaauuuggauugccgaaucccacaagaaacgacauuauuagguaucgauuauaugaagaacuuaaagcaaacggauacaaggaccuauacacaaacauuaaaaucccacaagaaaaacuauuuacaaaagaaauagacaucgagcauauaaucccaaaauccagaguguucgaugacaguuucucaaacaaaacacugagcuucagaaaaacaaaucuagauaagggcgaacgaaccgcauuugacuauauggaaucgaaauucggagcagacaaacuagaagaauacguagcgcguguugaagaucuauacaagaauaacauaauaaguaaagcgaaauaccaaaaacuauuaaagaaagaaagugaaauaggagauggauucgucgagagagauuuaagagagacucaauauauagcgaaaaaggcaaaggaaauccucuuacaaaucacuccaaauguacuaagcacuaguggcggaauaaccgaucgguuacgugaagacugggacuuaauaaauguuaugaaagaauuaaaccuacccaaguaccgagcacuagguuuaaccgaaauggaagaucgaaaguauggucagcaaguagaggugauuauugacuggaccaagaggaaugaucaccgucaccaugcaauggaugcguuaacuguagcguuuacaaaacauaaucacauccaguacuuaaauuaccuaaacgcuagaaaaaacgaaaaacauaaagaacauuccaacaucauggguauccaacagcuggaaacaauuaaagugacggacaaaaauggcaaugaaaagcgaguauuuaaagccccaaugccaaauuucagacaaguaacaaaagcauuccuggaaaacauccucauaucucauaaagccaaaaauaaaguuguaaccaagaauaagaacaaaguagcaggauccaacaaagugcaagaaguacuaacaccacgaggacaauuacacaaagaaacaguauacggaaaguaccaauacuacguucaaaaagaagaaaaaauagguggaaaauuugaccuagaaaccauaaagaaaguagccaacccauuauaccaaagccucuuaaaaaaaagauuagaagaaaacgggggggauccaaaaaaggccuuuacaggaaaauacagccuagccaaaaaucccauauaccuggacgaugcccaaacagagcaguuacccgaaaaaguuaaauuaguaugguuagaaaauuccuuuuccauuagaaaagacauuacgccggaaaauuucaaagacgaaaaauuaauagauaaaauauuagaugaaggcguuaaaaggaucuuaaaggaaagacugcagucauucggcaacgacgcaaaaaaggcuuucagcgacuuagacaaaaacccaauuuggcuuaacaaagaaaagggaaucacuauaaaacgaguaacaaucuccggcguagcaaaugccgaaccacuacauacuaaaaaagaccaccuaggaaaggaaauauuagauaaagagggaaaaccaauuccagucgauuucauaucgacagggaguaaucaucauguagccguauacagagaugagaaaggaaaucuacaagaaaaaguggucucaguauuugaagcaguagucagggccaaucaaggccuacccauaaucgacaaaacauacaaucaacaccuaggaugggaauuucuauucaccaugaaacaaaaugagauguucguauuucccaaugaaucuacaggauucaauccaaacgacauagauuuacuagaccccaaaaacaaaagaaucaucuccccaaaccuauuccgcguccaaacaaucucagugguuaaauacggaaaugcuauaguacgggacuuuaaauucagacaucaccucgaaacuacaguagaagauaaaaaggaacuucaagguaaaacauaucaacaaauuaaaagucuaagcccccuuaacgauauaaucaaagucagaauaaaucauuuaggagacaucguuucaguuggugaauauuga

SEQ ID NO: 9147 - RNA, 4293 nt, Artificial Sequence
  Cas9 variant
augaaacauauauuagguuuagaccuagguacuaauucaauaggcugggcauacgugaaagaagcagaaaacgauacggaaacuucagaaauaguagaccuaggaguuagaguaaauccacuaacaacagacgagaaaacaaacuucgaaaaaggaaaaccaauaucaacgaacgcagacagaacuuuaaaaagaucggcacgacguaaccuacaacgauauaaacuaagacgaaaagaacuuauugaauuauuaaaagaacaccaacugaucucagaaaauacaauccucacugaaaacggaaaaggcacuacauuccaaacacuagaacuaagagcaaaaucagcaaaagagaaaauuucucucggugaauuagccagaguuuucuuaaccauaaauaagaaacguggcuacaaaaguucucgaaaagccaaaaaugaagacgaaggccaacuaauagacggaauggaaaucgcaaaacgacucuaugaagaaaacuuaacaaccggccaauuauccuuacaauuauugaaagaagggaagaaaucauuaccagacuacuacagaagcgaccuacaauucgaacuagauaaaguauggaauuuucagaaacaauuccauagugauauccucacagacgaauuuuaugcccaacugaaaggaaaaggccaaagagccaccucggcacucuuucuagcaaaauaccaaauauauaccgcagaaaacaaaggaucaagagaagauaagaaacuacaggccuaccaauggcgaguugaugcauuaucaaaagaacuuaccagagaacaauuagcauuuguaauaaccgaaaucaauaacaaucuaaacaacucaucaggcuaccuuggggcaauaucugacaggagcaaagaacuguauuucaacaacgaaaccguaggagaauacuuauggaaacaaauagcagccaacccacauaccagccuaaagaaucaaguauuuuaucgccaagacuauuuagaugaguucgaacaaauauggaauacucaagcacaauucuauccccaaauacuuacagaugaacuaaagaaagaauuaagagacguagucauauuuuaccaaagaaaauuaaaaagucaaaaaucauuaguuagcuucugugaauuugaaaauaaagaaauagaaaucaagaaagaagauggaacuagcacuaagaaaguuauagguuuaaaaguugcaccgaaaucuaguccacuauuucaagaauuuaaaaucuggcagaaucuaaacaacguacucauaaggaagaaaggcucaaaaacgaagaaagcggcuaaaaaccaacaagcaguacuauucgaagaagagaaaacgauaucagaacuagaucuagaagcaaaacaagcacuauuuaaugaacuaaaccuaaaaggcaauuuaaaagcagacuauugccucgaaauacuaggcuacaguccgaaagaaugggaaaugaauuauuccguccuagaagguaauagaacuaacaaagcauuauacgaagccuaccuaaaaaucacagaccucgaagguuaugaugccaaaaaccauuuaaaaguaaaauuaaauaaagacgaaguagaacuagacgauuuaaaaguucccgcaucagaaauaaaagaaaugguucaagcaauuuuuaaagaagcuggaauaaacacagacauccuucacuucaaugcagaacuagacgguaaagauuucgagaaccaggcuucauaccaacuguggcaccuccuauauuccuacgaaggagaugacucgaaaucagguaacgaauuauuauauaaauuacuagagacaaaauucgguuucaagaaagaauaugcacaaauacuugcaaacguuagccugucagacgauuacgguaaccugagcaccaaagcuaugaggaaaauuuauccauacauaaaagagaauaaauuuucuacagcuugcgagcuagccggcuaucgacacuccaaacauucacuaacaaaagaagaaaacgauaacagaguacucaaagacucccuagaaguucucaagaaaaacucacuaagacaaccaguaguagagaaaauacuaaaccaaaugauaaacuugguaaacgcacuuuugaagaaauacagaacagaaaauccuaacuucaaauuugaugaaaucagaauagaacuggcccgcgaacuaaagaaaaacgcagaagaaagagcaaacaugacugcuaauauaaacaaagcgaaaacggaacaugagaaaaucauaaaaauacucaaaaacgaauuugggcuaccaaacccaacccgaaacgauauuauucgauaucggcuauacgaagaauuaaaagcaaacggauauaaagaccucuauacaaauauaaaaauuccgcaggaaaaacucuuuaccaaagaaauugauauagagcacaucauaccaaaauccagagucuucgacgacaguuucaguaacaaaacauuaucuuuccgaaaaacaaaccucgauaaaggcgaaagaacagcauucgacuacauggaaaguaaauuuggagcugacaaacuagaagaguauguagcuagaguagaagacuuauacaaaaacaacaucauaucaaaagcuaaauaucagaaacuacugaagaaagaauccgaaaucggugacggauucguagaacgugaucuaagggaaacacaguauauagcgaagaaagcaaaggaaauauuguuacaaauaacaagaaauguacuuuccaccagcggggguauaaccgaucgauuaagggaggacugggaccucgucaacguaaugaaagaacuaaaucuaccgaaauacagagcacuaggacuaacagaaauggaagaccguaaguauggucagcaaguggaaguaaucaucgacuggacaaaaagaaaugaucauagacaucacgcgauggacgcacucacaguagcauuuacaaaacacaaccauauucaauaccuuaacuauuuaaacgcacguaaaaaugaaaaacaccgcgagcauucuaacauaaugggaauccaacaauuagaaacaaucaagguaacugauaaaaauggaaacgagaaaagaguuuucaaagcaccaaugccaaacuucagacaagucacaaaagcauuccuagaaaacguauuaauaucccauaaagccaaaaacaaagucguaaccaagaauaaaaauaaagucgcagggucaaauaaaguacaagaagugcucacaccgagggggcaauuacacaaagaaaccguuuacggaaaauaccaguacuauguccaaaaggaagagaaaauuggagggaaauucgacuuagaaacuauuaaaaaggucgccaacccauuauaccaaucuuuacuaaagaaacgacuagaagaaaacggaggagauccaaagaaagcauucacaggcaaaaauucguuagcuaaaaaucccaucuacuuagacgacgcacaaacugaacaauuacccgaaaaaguaaaacucguuugguuagagaacucuuuuucaauuagaaaagacauuacaccagaaaauuuuaaagaugaaaaacuaaucgauaaaauauuagaugaaggaguaaaacguauacuaaaagagagauuacagucauuuggaaacgaugccaagaaagccuucucagaccuggauaaaaaccccaucuggcucaauaaagaaaaaggaauuacgauaaagagaguaacuaucucaggaguggcaaaugccgaaccuuuacacacgaaaaaggaucaccuagggaaagaaauucuagauaaagaaggaaagcccauuccagucgacuuuauaagcacagguagcaaccaccacgucgcaguguauagggacgaaaaaggaaaucuccaagaaaaggucguuucagucuuugaggcgguaguacgugcaaaccagggccuaccaaucauugacaaaacuuacaaugaacauuuagguugggaguucuuauuuacgaugaaacagaacgaaauguucguauuccccaaugaaucuacaggauucaacccaaacgauaucgaccuguuagaccccaaaaauaaacgaauaauaagcccaaaccuauuuagaguacaaacuauuagcguaguaaaauacgggaacgccaucguacgagauuuuaaguucagacaucaucuugaaacuacuguugaagauaagaaagaacuacagggcaaaacauaucaacaaauaaagagcuuaaguccgcuaaaugacaucauaaaagucagaauaaaucauuuaggggauauaguaagugucggggaauacuga

SEQ ID NO: 9148 - RNA, 4293 nt, Artificial Sequence
  Cas9 variant
auggcacaaaaauauauacucggauuagacuuaggaaccaacuccauuggaugggccguaguaaaagaagcagaaaacgacaaugaacagucagaaauagucgacguaggaguuagaguuaauccacugacaacggacgagaaaaccaacuucgaaaaaggcaaaccaauaucgaccaacgcagacagaacuuuaaaacggggagcacgaaggaaccuacaaagauacaaacuaagacgaaaagaacuaauuaaaauauuaaaagaacaucaacuaauaagugacgauacuauacuagcugagaacggaaaaggaacaacauaucaaacccuaaaauuaagagccaaaucaaguaaagagaaaaucagucuagaagaacucgccaggguuuuucuaaccauaaacaagaaaagaggauacaaaucaucgcguaaaaccaaaaacgaagaugaaggacaauuaauagacggaauggaaauugcaaaacgccuauacgaagagaacuuaacaacaggacaacuaaguuuacaacuccucaaagaaggaaagaaaucucuaccugacuacuaccgaucagaccucgaacucgaauuagauaaagucuggaacuuucaaaaacaauuucacucagacauacuuacagacgaguucuauacgcaacuaaaagguaaaggacaacgcgccacgucggcgcuauuucuugaaaaguaccaaauauauacaguagagaacaaaggaaauagagaagagaaaaaccuucaagcauaccaauggagaguggaugcccuaagcaaagaacuaacaagagaggaacuagcauuuguaauuacggaaaucaauaauaacuuaaauaauucuaguggauaccuaggagcaauaucagauagaucaaaggaauuguauuuuaacaacgaaacaguaggagaauacuuauggaaacaaaucgccgcuaauccacacaccagucugaaaaaucaaguauucuacagacaagacuacuuagacgaguucgaaaggauauggaacacacaggcucaguuuuacccacagauuuuaaccgaaaguuuaaagaaagaauuaagagauguaguaauuuucuaccaaagaaaauuaaaaucacaaaaaucucuagugaguuuuugcgaguucgaaaacaaagaaauagaaaucaaaaacgaagaugggacaacaacaaagaaaguaauaggacuaaaaguggcacccaaaucaaguccccucuuccaagaauuuaaaauuuggcaaaacuuaaauaauguauuaaucagaaagaaaggaagcaaaaccgaaaaagucgccaaaaaucagcaaguaguguuguucgaagaagagaaaacaauaagugaauuagaccuggaagcaaaacaagcucucuuuaacgaacucaaccuaaaaggaaacuuaaaagcagauuacugccucgaaauauugggauauaguucaaaagagugggaaaugaacuauaguguacuggaaggaaacagaacaaauaaagcacuauacgaagccuaucucaaaauaacagaucuagaaggauaugaugccaaaaauuaccucaaaguaaaaaguaauaaagaugaaguggaacuagacgaucuaaaaguccccgccucggaaauaaaagaaaugguccaagcaauauuuaaagaagcaggaauaaauacagacauacuccauuucgaugcagaacuugacggaaaagauuuugaaaaccaggguaguuacaaacuauggcaccuguuauacucuuaugaaggagaugauagcaaaagcggaaacgaacuuuuauauaaacucuuagaaacaaaauucggauugaagaaagaauaugcccaaauccucgccaauaucucccucucagacgacuacggcaaccuaucaaccaaagcaaugagaaaaauccaccccuacauuaaagaaaacaaauuuucaacugcaugcgaacuagcgggauaucgacacagcaaacauucucuaacaaaagaagaaaacgaaaaacgaguucuuaaagacggcuuagaaguacuaaagaaaaacaguuuaaggcaacccgucguugagaaaauacucaaucaaaugauuaaucuaguaaacgcguuauugaagaaauacagaaccgaaaacccaaauuuuaaauuugaugaaauccgaauugaacuagccagagaacugaagaaaaacgcagaagaacgugcuaacaugacggcaaauauaaacaaagcgaaaaccgaacacgagaaaauagauaaaauauuaaaaucagaauuuggauuaccaaaccccacacgcaaugacaucauccgcuacagguuauacgaagaauuaaaagcaaacggauauaaagaucuuuauacaaauagauacauaucuucugaaaaauuauucucgaaagaaauagauaucgaacauaucauucccaaaucaagaguuuucgaugacucuuuuucuaauaaaacaaucguauaccguacggauaaccucgauaaaggcgaacaaacugcuuaugacuacauugaaucgaaauucggagccgaaaaacuuaaagaauacaugacucgaguaaaagaccuauaucaaaagaaaaucaucaguaaagcgaaauaucaaaaacuauuaaagaaagaaucugaaaucggcgacggauuuguagaaagagaucuacgugaaacacaauauaucgcgaagaaagcaaaagaaauuuuacuacaaauaacacacaacguccucucuacaucaggcggaauuacagacaggcucagaaaagauugggggcuugucaacgugaugaaagaauugaaccucccaaaauacagagcauuaggcuuaacuaaaauggaagaccgaaaauauggacaacagguagaaguuauuacagauuggaccaaaagaaacgaccuucgacaccacgcaauggacgcgcuaaccguagcguucaccaaacauaaccauauccaauaucuuaacuaucucaaugcaagaaagaaugaaaaacacaaagaacacaacaacauaauggcaauccagcaacuagaaaccauaaaaguaacggacgaaaaugguaacgagaaacgaaucuucaaagccccaaugcccaacuuuagacaaguagcaaaaacauuuuuagaaaauguauuaauaucucacaaagccaaaaacaaagucguuacuaaaaauaaaaacaaaaucucagggaguaauaaagugcaggaaguacuuacaccaagaggacaguuacacaaagaaacagucuaugguaaauaucaauauuacguacagaaagaagagaaaauaggagcaaaauuugauagugaaaccauugaaaagguugcaaaucccuuauaucaaucacuacucaagaaacgauuggaagaaaacgguggcgacccaaagaaagcguuuaccgguaaaaacucacuugccaaaaacccaauauaccucgaugauacacaaacugaacaacuacccgaaaaaguuaaauugguaugguuagaaaauucuuucucaauaagaaaagacauaacacccgaaaacuucaaagaugaaaaauuaauagacaaaauuuuagacgaaggcgucaaaagaauacugaaagaaagacugcagucguuuggaaaugaugcaaagaaagcauucagcgaucuagagaaaaaucccauauggcuaaauaaagaaaaaggcauagcaauuaaacgagugacaauaucuggaguagcuaacgcagaaccacuccacacaaagaaagaucaucuagggaaagaaauauuagauaaagaaggcaaaccuauuccggucgauuuuauaucaacuggaaacaaccaucacguagcagucuacagagaugaaaaaggaaaccuucaggaaaaaguccuauccguauuugaagcaguggugcgagcaaaucaaggucuaccuauaauagagaaaacuuauaaucaacacuugggaugggaauuucuauucagcaugaagcagaaugaaauguuuguauucccuaacgaaucaacaggauuuaacccuaaugacauagacuuauuagaucccaaaaauaaaaggauaauaucaccuaaccuauuuaaaguacagaaacuagcaaccaaaaacuauauguuuacccaccacuuagaaacaaaaucaaucgauggggauaugcuaaagaacaagaaagaauuaucaggaauacucuacaauuuuauccaaacaccacaaaaacuguauggaauaauaaaaguccgaauaaaccaccucggagacauugucuccguaggugaauauuga

SEQ ID NO: 9149 - RNA, 4296 nt, Artificial Sequence
  Cas9 variant
augaaacgcauacuuggccuagaccuaggcagcagcagcauagguugggcgcuaguaaaugaagcugaaaguaaaaacgaaagaucaucaaucguaaaacuagggguacggguaaauccacuaacaguagaugaaucuauuaacuuugaaaaaggaaaauccaucacgacuaaugcggauagaacguuaaaaagaucuaugcgaaggaaucuacauagguacaaauuaagaagagaagcauugauagaaguucuaaaggaauguaaauucauaacagaggauacaauacucagugaaaacggaaacaggacgacuuuugaaacguauagauuaagaguaaaagccuuaaccgaagaaauaucucucgaggaauuugcacgaguacuuauaaugauaaacaagaaacgugguuauaaaucaucacguaaagcgggcggagcagaagaagauacacuaauagacggaauggauauugcacgaaaauuauacgaugcaaauuuaacgccaggcgaauugugccugcaauugcuaucagccgguaagaaaguuuuacccgauuuuuacagaucagaccuccagaacgaauuagaccgaauuugggaaaaacaaaaagaauacuauccugguauauuaacggcagcacuaaaagaagaauuaagagggaagaaaagagaugcugugugggcaauaugcgcaaaugcauuuguauggaaagaaacauauacagaauggaacaacgaagaaaguaaaaacgagcaaaucgaaaaagaacacaaauuagaaggcauauauagcaaacgaaaaagagaugaagcuaagaaagaaaaccuccaauggcgaguaagcgguuuaaaagaaaaacuaucacuagaacagcuaguaauaauccuacaagaaauuaauacacaaauaaacaacucaucaggauaccugggcacaauaagcgaucgcucuaaagaauuauauuucaauaaacaaacaguaggccaauacuugauggauauauuggacaacaacccgaacgcaagccuaaggaacauaguuuucuacagacaagauuaucuugaugaguuuaauguacucugggaaaaacaagcggaguuucauaaagagcuaacaggagaauugaagaaagaaauccgagauauaauaauauucuaucaaagaagauuaaaaagucaaaaaggccuuauaucuuucugugaguucgaaucaagacaaauagaaguaaaaauagacggaaaaagaaaaauaaggacgguaggcaaucgcgucauaccaaggagcaguccucuauuccaagaguucaaaauauggcaaauacucaacaauaucgaaguaacagcaguagguaauaaaaauaaacaaagaaugcaaaacggaagcaaugaaccagaugacacagaacaacuagaacucaauggaagacgauaucucuaucaagaggagaaagaacuacuugcaaaagaacuauuuguaagagauaaaaugacaaaacuagacgugcuaagacuacucuucgauaauccagaagaauuagaccuaaauuucaaaacaauagauggcaauaaaacaggcuaccucuucuuucaggcuuacagcaaaaugauagaaaugucgggccaugaacccguagauuucaagaaacccauagagaaaauaguagaacaagugaaaucaguauuuguauuacuaaacuggaauacagauauacuauccuuugauaguaacaaagaacucgacaaacaaucauacuauaaacuauggcaucuuuuauauuccuucgaaggugacaacacaccuacagguaauggaugccuaguacagaaaauaauggacucuuauggguuaggaaaagaauuugccaaaauucuagcuaauauuacauuccaagaagacuaugguagcuuaagugcaaaagccauucacaaaaucuugccacauuuaaaagaaggcaaucaauacgacguagcaugugaauacgccgguuauaggcacagcaaaucuuccuuaacaaaggaggaaauagcaaauaagguccucaaagacaaacuugaaguacuuccaaggaacagucuaagaaauccugucguugagaaaauacuaaaucaaaugguuaauguaauaaaugcuauaauagaagcauacggcagaccagacgaaauaagaguagaacuagcaagggaacuuaagaaaaacgcgaaggaacgagaaaagcugacaaagaguauagccgaaacuaccaaaacccacgaagcucacaagaaauuacuccaagaagaauuuggauuaaagaacguaggccguagcgauauucuaagauacaaauuguacaaagaauuggaaagcagagguuauaaaacgcuauauaguaauacauauauaccgagagaaaaauuauucucgaaagaguuugauauagaacauauaaucccacaagcgcgauuauuugacgauaguuucucaaauaaaacacuggaagcaagaaauguuaacauagagaaaggcaauagaacagcauaugacuucgugaaagaaaaauuuggugaaagcggaacagauaauagcuuagacugcuaucugaauaacauagaaguauuauucguaucuggaaaaauaagcaaaaccaaauacacaaaacucaaaaugacugaacaagacauacccggaggguucauagaaagagaccuuagaaacacccaauacauugcaaagaaagcacugucuauguuaaaugaaauaagucguuguguaguagcuacuucuggaaguauaacugauaaauuacgugaagauuggcaauuaguagacguaaugaaagaacugaauugggaaaaauauaaagcgcuggguuugguagaauacuuugaagacaaagauggaaaacaaauaggaagaauaaaagacuggagcaaaaggaaugaucaucgucaccacgccauggaugcauuaacagucgcuuucacaaaagaaguauucauucaauacuuuaauaauaagaacgcuagccugaacccaaacacgaaugaauaugccauuaaaaacaaauacuuucaaaacgggagagcgauugcuccaauaccccuaaaugaguucagagcagaagcaaagaaacacuuggaaaacacauugauuucaaucaaagcuaaaaacaaagugauuacgaauaauaucaacaaaaccaagaaaagaggaggagucaacaccaagaaacaacaaacaccacggggccaacuucacuuagaaacaaucuacggauguugccgacaauaccucacaaaagaagaaaaaguuaacgccuccuucgacgugucaaaaauagcaacggucagcaguucaguauaccgagaugcacuccuaaaacgccuacaagaacaucacaacgacccuaagaaagccuuugcaggacgaaauaguuuagacaagaaaccaguauggcuugauaaagaacaaauuagaaaaguaccagaaaaaguaaaaacaguaacauucgaaacuauauauaccauacggaaagaaauaaguccagauuuaagaguugauaaaauaauagauuccgggguaagaaaaauguuaacagguaggcuaaaagaauauggcaacgacgccaaaaaggcuuuuucgaaccuagacgaaaaacccauaugguugaauaaagaaaaaggcauaccaauaaaaagaguuacaauuagcggaauaucgaaugcacaaucccuucaugucaagaaagacaaagacggaaaaccaguccuagacggaaacggaagaaacauaccuguagacuucgugaacacaggaaauaaccaccauguugcaguauacagacgaccuguaaucgauaaaaacggacaaaugguaauagaugaaaaugguaacuuaaaauaugaauuagaggaaguugucguaacauucuuugacgcaguaacaagagucaauuuaggucaaccgauaaucgauaaagacuacaaagccucagaagguuggcaauuucuauuuaguaugaaacagaaugaauauuucgucuuucccaauaagaaaacuggcuucaauccuaaagaaaucgaccuacuagaugcagacaauuacggacuaauuagcccgaaucucuuccgaguucaaaaauuuacucauaaaaacuacguauuuaggcaccaccuagagacaacuauuaaagauaccucauccauuuuacggggaauaacauggauagacuuuagaagcagcaaaggauuagacagcauaguaaaaguacgagugaaccacauagggcagauaguaucugugggagaguauuga

SEQ ID NO: 9150 - RNA, 4299 nt, Artificial Sequence
  Cas9 variant
augaagaaaauuuugggacucgauuuaggauccaacaguaucggaugggcacuuguuaacgaagccgaaaacagagaugaagcaucgagcauaauaaaauuaggaguacguguaaacccauuaacaguagacgagaugcaaaauuucgaaaaagggaaauccauaacuacaaaugccgauagaacauuaaaacguagcaugaggagaaaccuacaacgauacaaauuaagacgagacgcucuaauuaaacugcuuaagaaaguaggauuuauagcagaugguacuauuuuaagugaacaaggaaauagaucuacuuuugaaacguaucgucucagagcuaaagccccagacgaggagauaucccuucaagaauuagcacgaguacuauuaaugauaaacaagaaaagagguuacaaaagcucgagaaaaauaaaagaaaaagaagcaggaacguuaauagaugguaugaaagucgcaaagaaauuauacgacgaagauuuaacaccgggacaauuaugcuuacaacuccuugaaucaggaaagaaaagccugccagacuuuuauagcucagauuuacaagaagaguuugaucgaauuuggaauuuucagaaacaauuuaacccaaaagccuuuugcgauacagcuaaagaagagaucaaagguaaaaacaaaucacaaacaugggcuauacucgcaaaauacuucauuuggacagacgaaaugguuguuuggaacgaaaaagaaaguaaaaccgaaagagucgaaaaagaauguaaauuaguuggauuaaaacgcacaguuaagaaagaagaacaaagaaaagaaaacuauagauggagaguacaagcccuaaccgaacaacuagauuuaggaaaaguagcaguuguacuucaggaaauaaacggccaaauauccacaucaagcggcuauuuaggugcaauaagcgacagaucuaaaguauuauauuuuaacaggcaaacaguaggucaauaccaaauggcagaacucgagaaaaauccaaauacgagucuaagaaauaugguauuuuaccgacaagacuauuuagaugaauuugacaagaucugggaaaaacaggcagaguuccauaaggaauuaacugucgaacucaaaaaggaaauaagggauauaauaauauuuuaccaacgacgauuaaaaagucaaaaaggcuuaauuggauucugugaguucgaaaauagagaaaucaugguggagaaaaauggaaaaaugcaagcaaaaguagugggcuguaaaguaauaccaaggucacacccucuauuccaagaauuuaagauauggcagacucucaauaauguagaaguauuugcaggcgaaaagaaauguaaaagaaaaagaacugaugcauuuccuggcuuguuugacggcacagaagauaccuuaaugguagaaggguggcgauacuuauaucaagaagagaaagaaauccucgcaaaagaguuaagcguaaagaaaucauuaaagaaagaauacauacucaaacuauuauuugacaauccccaagacuuagauaugaauuucgaacaaauugaaggcaacgacacagggaauguacucuucagcgcauauagcaaaaugauugaaaaauacggguaugaaccacuagauuucgggaaaucuacagacgaaauuauagaacgacuacaaguaaucuuuaccgaucugggcuggaauaccgaccuauuauuuguagaucucaauaaagaagggaaagauuuggaaaaacaaccauauuuuaaauuauggcaucuucuauacucauucgaaggcgauaauacaccaaccggcaacggcaaacugguugagaaacucauggaacuaugucauguuggaaaagagugugcacuugagcuaguaaacauuucauuucaaaacgacuaugggucacuuagcgcaaaagcaauaaagaaaauauuacccuauuuaaaagaagggaaucgguacgauguggcaugcggauaugccggauaucgucacagcaaauccucacuaacaaaagaagaaaucgaaaacaaaguauugaaagacaaacucgacauacucccuaaaaauagucucagaaauccagugaucgagaaaauacuaaaccaaauggugaacguaauaaacgcuauaauugauacauacggaaaaccugacgaaauaagaguugaauuagcaagagaacuaaagaaaagugcaaaagaaagagaugaauuaacuaaagcuauagcaaaaucaacaagagaacaugaagaaauacguaaaguucuacaagaagaguucgguaugauaaacgucucaagaaacgauaucauacgauacaaacuguaugaagaacuaaaagauaacggauacaaaacucucuauucuaaccaauacaucccgaaggaaaaaguauuuucaaaagaaauugauauagaacacauaauaccacaagcuagauuguuugaugauucauuaucuaauaagacacuggaauauaaggcaauaaacauagaaaaagggaauaaaacugccuaugacuucguaaaagaaaaauacggggaaaaaggauuacaacaguaucuaaaccgaugugaaucguuauucaaaggacaccggacaaaacuucgaaaauuaaaaauggggcaagaaaacauucccgagggauucaucgaucgggauuuacgcaacacgcaauacaucgcaaagaaagcguuagcuaugcuaaacgagauauguagacgugucgucgcaacuacugggaguauaacugacagauuaagagaagacuggcaauuaguugauguacucaaagagcucaacuuacccaaauacgaaacacuaggauuaguagaggucuaugaagauaaagauggcaggaaaauaaaaagaauaaaggauuggacuaagagaaacgaucaccgacaucaugcaauggacgcacugacagucgcauuuaccaaagauguuuuuauacaauacuuuaacaauaaaaacgcugcuuggcaagcagauuguaaagaacauagugacauuauagguauaaagacuagauauuuugaaaaugguagagcacuacccccaaugccucuaguuagauuuagagccgaagcaaagucucauuuagaaacacuauuaguauccauaaaggcuaaaaacaaaguaguaacuaauaauguaaauugcaccaaaagaaaagguggugaaaacaagaaacugcaacaaacaccacgcgggcagcuacaccucgaaacaauauacggaucccauagacaauacguaaugaaagaagaaaaaguuaaugcaucauucgauucaucaaaaaucgcaacgguauguaaacaggcauacagaaacgcauuauuagaaagauuagcggcauucgggaacgauccgaaaaaggcuuucacggguaaaaacagccuagagaaaaauccaguuuauuuggacagagagcaaacagcgagagucccugaacgaguaagaacgguagaacucgaaacgguuuauaccauucgaaaaccaguagacccuaaccuaucaguagacaagguuguugacgcaaaaguccggaguaucuuagaacaaagauuaagagaauaugauggagaagcaaaaagagccuuugucaaucuggacgaaaacccaauaugguuaaaugaagagaaaggaauugcuauaaagaggguaacaauaaggggaauaaacaaaguucaaucauuacacgguaagaaagacaaaaacggcaacuuaauacuagacgaaacagguaaaaagauacccguagacuucguaaauacaggaaacaaucaccauguagcaauauauagaaagccaguucuugauaaaacaggacaagaaaugcuagauaacgaaggaaauccaguauaugaauuagaugaaguaguaguaaguuucuuugaagccguaacuagagucaauuuaggccucccaguuauagacaaaaauuacaacaagucagaaggauggcaauuuauguuuaccaugaaacaaaaugaauacuuuguauuuccaaacgaaaagacaggauucgacccaaaagagguagaucucuuaaacccagaaaacuaugccguaauaagccccaauuuguucagaguacaaaagauaacagaaaaggacuacauguucagacaccacuuagagacaaaaguaguagacgacaaguuuuuaaaagagauuacauggaagagaauauuaacuccaaauaaacucgaaggcauaguaaaaguucggguuaaccacauuggccaaauugugagcgucggggaauauuga

SEQ ID NO: 9151 - RNA, 4299 nt, Artificial Sequence
  Cas9 variant
augaagaaaauacuuggcuuggaccuagggaguaacaguauagggugggcucuaguaaaugaagcagaaaauucagaugaagugaguucaaucauaaaacuuggaguccgagucaacccccuaacaguagacgaaaugcaaaacuuugaaaaaggaaaaucuauaacaacaaacgcagauagaacauuaaaacgaucgaugcguagaaaucugcaaagauacaaacuaagacgagacgcccugauuaaauuacucaagaaagugggauucauaaccgauggaacaauucuauccgaacaaggaaacaggacaaccuuugaaacauaccgauuaagagccaaagcaccagacgaagaaauaagccuccaggagcuugcuagaguguuacuuaugauaaauaagaaacgaggcuauaaaucgucaagaaaaauuaaagaaaaagaagccggcacguuaauugauggaauggaagucgcaaagaaacucuacgaugaagaccuaacacccggacaauuauguuuacaacuacuagaaagugggaagaaaagucugccagauuucuacaguagcgaccuccaggaagaauuugaccggauauggaacuuucaaaaacaauuuaauccaaaagcauuuugcgauacagcaaaagaagaaauaaaagggaaaaacaaaagucaaacgugggcaauauuagcgaaauacuuuauauggacagaugaaaugguaguuuggaaugaaaaagagagcaaaacagaacgaguagaaaaagaauguaaauuaguuggacuaaaaagaaccguaaagaaagaagaacaaaggaaagaaaauuacugcuggcgaguacaggcacuuacagagcaacuagauuuagaaaagguugcgguugucuuacaagaaauuaacggacaaauaucaacgucuaguggauacuuaggagcaauaagcgaccgcagcaaaguccuauacuuuaaucgacaaacugucggacaauaucaaauggccgaauuagagaaaaacccgaacacaagccuaagaaacaugguauucuauagacaagacuaucuagaugaauuugauaaaaucugggaaaaacaagcagaauuucauaaggaacuaacaguugaauuaaagaaggaaauaagagauauuauuauuuucuaccaacgaagacuaaaaucacaaaaaggucuaaucggguucugugaauuugaaaauagagaaauaaugguugagaaaaauggaaaaaugcaggcaaaaguaguggguugcaaaguuaucccaagaagucauccacucuuucaagaauuuaaaauauggcagacguuaaacaacguugaaguauuugcaggcgagaagaaauguaaacguaaaagaacagacgcauucccaggcuuauuugacggaacagaagauacauuaaugguagaaggauggagauauuuauaucaggaagaaaaagaaauacuagcaaaagaauuaagugucaagaaaagucucaagaaagaauauauacugaaauuacuauucgauaauccacaggaccuugauaugaacuuugaacaaaucgaagguaacgauacgggaaauguauuauucagcgccuacaguaaaaugauagaaaaauacggcuacgagccacuagacuucgguaaaccaacugacaaaaucauagaacagcuacaaguuauauucgcagauuuaggauggaauacagaccuuuuauucguagacuugaacaaagaaggaaaagaucuagaaaaacaaccauacuuuaaauuauggcauuuauuauacagcuucgaaggagauaauacgcccacaggaaauggaaaauuaguagaaaaauuaauggagcugugucauguuggcaaagaaugcgcuuuagaguuaguuaauauaucauuucaaaacgacuauggauccuugucagcaaaagcaauaaagaaaauacucccguauuuaaaagagggaaauagauacgauguagcgugcggauaugcaggauaucgacacucaaaaagcucucugacuaaagaagaaaucgaaaauaaaguccugaaagauaaauuagauauucugcccaaaaauagucuacgaaacccaguaguagagaaaauauuaaaccaaaugguaaauguaauaaaugcgaucauagacacuuacggaaaaccagaugaaauacgcguugaacuagcgagagaauuaaagaaaucugccaaagaacgagaagaauuaacaaaagcgauagcgaaauccacgagagagcaugaagagauacgcaaaguuuuacaagaggaauuuggaaugauaaauguuucaagaaacgacaucauacgauauaaauuauaugaggaacuaaaagacaacggguacaaaacacuuuauagcaaccaauacaucccgaaagaaaaaguuuucagcaaagaaauagacauagaacauauaauaccgcaagcgcgacuuuuugacgacucauugaguaacaaaacacucgaauacaaagcaauuaauauagagaaaggaaauaaaacagcuuaugacuuuguuaaagaaaaauauggagaaaaaggcuuacaacaauauuugaacagaugcgaaucauuauuuaaaggacaaagaacgaaacugaggaaacuaaaaaugggccaagaaaacauaccagaaggcuucauagaucgcgacuuaagaaauacgcaauauauagcuaaaaaggcauuagcaaugcugaaugaaauuuguagaagagugguagcaaccacaggcucaauaacagaucgacucagagaagacuggcaauuaguggauguauuaaaagagcuuaauuuaccuaaauaugaaacauuaggauuaguggaaguauacgaagacaaagaugguaggaaaauaaaaagaauuaaagacuggacaaagagaaacgaucauagacaccaugcaauggaugcauugacgguagcauucacaaaagacgucuucauacaauauuuuaauaacaaaaaugcagcauggcaagcagacuguaaggaacacagugauauaaucgggauaaaaacacgauauuucgaaaacggacggagucuaccuccgaugcccuugguaagguuucgggcagaagcuaaaucucauuuagaaacacuauuaguaagcaucaaggcgaaaaacaagguaguuaccaauaaugucaacugcacaaaaagaaaagguggagaaaacaagaaauugcagcaaaguccuagaggacaacuccaccuugaaacaauuuacggcagucauagacaauacguaacaaaagaagaaaaaguuaaugcgagcuuugauagcucaaaaauagcaaccguaugcaaacaggcauacagaaaugcacuacuggagagacuagcagcauucggaaacgauccuaaaaaggcauucaccggcaaaaacucucuagaaaagaacccaguauauuuaaacagggagcaaaccgcaagaguaccagagagaguuagaaccguagaauuagaaacgguuuauacaauaagaaaacccguagacccuaacuuaagcguagauaagguaguagacgcaaaaguccgcaguauacuagaacaaagacuaagagaauaugacggagaagcaaaaagagcauucgucaaccucgacgagaauccgauaugguuaaacgaggagaaaggaauagccauaaaaaggguaacaauaagggggaucaauaaaguccaaucauuacacgguaagaaagauaaaaacggaaauuugauucuagaugaaaccgggaaaaagauaccaguugacuucguaaauaccggaaacaaccaucauguagcgaucuacagaaaacccguacucaacaaaacagggcaagagauguuggauaaugaaggaaauccaguauacgaacucgaugaaguaguuguuucuuucuuugaggcugucacaagagucaaucuaggacuacccguaauagacaaaaauuauaauaaaagcgaagguuggcaauuuauguuuacaaugaaacaaaacgaauauuucguuuucccaaacgagaaaacccgguucgaucccaaagaaguugaccuuuuaaaucccgaaaauuaugccgugauaagcccaaacuuauucagaguacagaaaaucacugaaaaggacuacauguucagacaccacuuagaaacaaaagugguagacgauaaguuucuaaaagaaauaacauggaagcgaauacugacuccaaacaaauuagaagguauagucaaagugagaguaaaucauaucggacaaauaguaagcguaggggaauauuga

SEQ ID NO: 9152 - RNA, 4299 nt, Artificial Sequence
  Cas9 variant
augaaaaauauacuaggauuagauuuaggaacgacaucuauuggauucgcgcauauagucgaagacgaaaacaaagaaaaaucagaaaucaaagaacucggaguccgaauaguuaguuugacaacggaugaacaaagugacuuugaaaaagguaaaaguauaacaacgaacgcaaaucgaacguuaaaacauggagcaagacuaaaccucgaccgauaucaacaaagaagaaaauaccuaauagaccuacugcauaaagcaaaccucauaacgccaaguucaauauuagcugaaaauggcaaaaacacgacacacaguacauggcaacuccgagcaaaagcagucacagaacggauugaaaaagaagaguucgcacguauacuacucgcaauaaacaagaaaagaggauauaaaucaucgagaaaagcuaaaacggaagacgaaggacaagcuauagauggaauggcaauagcaaaaagacuauacgaugaaaaucuuacgccaggucaauuguccuugcaacuucuacaacaaaacaagaaacuauuaccagacuuuuaccgauccgaucuccaaaaagaguucgaccucgucuggaauuuucaaaaacaauucuacccagacauacuaacugauauuuucuauaaagaacuucaaggaaaagguaaagacgcuacgucaaaagcauucucgaaaagauaucacuucgacacagccgaaaacaaagguucaaaagaaaguguuagauugcaagcguaccaauggcgugccgaagcagucucaaaacagcuaucaaaagaagaaguagcuuacgugcuuacggaaauaaacaacaaccuaaacaaugcuucaggauaccuaggugcaauuucugauagaagcaaagaacucuacuuuaauagacagaccguaggacaauaccuauaugcacaauuacaggaaaaucgucauaauagucucaaaaauaaaguauuuuaccgucaagacuaccuagacgaauuugaaagaaucugggaaacacaagcacuauuccauaaagaacuaaccgacgaacuaaagaaacaaauccgugauguagugauauucuaccaaagaaaaccuaaaucacaaaaaggucuaauaucguucugugaguucgaaucaaaagaaaucgaaauagaaaaagacggcaaaacaauuacuaaaaauaucggagcaagagucguucccaaaagcagcccauuauuccaagaguucaaaaucuggcaaauacuaaacaacguaaucuguaaacgaaaaggaauaaggaagaagaaaauauccgccaaaacuacccaacuagacuuauuaaaugaauccagucaaaccauauucagucuagauauggaaugcaaacaacuacuauucgacgaacuaaaucucaaaggagacuuaaaaagcgacaaaguauuaaaacuacuaggauacucaccacaagaaugggaaaucaauuauaaccaguuagaaggaaacagaacacaaaaagcucuauaugaagcauacuuaaaaauaguagaaauggaagcacacgauguaaaagacauacuucaaauaaaaagcacaaaagaugacuggucauuagacgaaagcccacuaagugcaucagaaauacgagaaucgguaaaagcgauauuucaagcguuaggcauuuguaccaaaauccuauacuuugaccccuuauuaccggugaaagauuucgaggaacaagauuccuaccaacuauggcaccuccucuauaguuacgaauccgacgauaguacaucaggaaaugaaacacucuacagaauacuagaaaagaaauaugcauuuaaaagagagcacgcaagaaucuuagcaaauguggcccuacaagaugacuacggaagccuaucuacaaaagcuauacgaaaaauuuaccccaacauuaaagagaaucaauauucaacggcaugcgaaauggcgggauauaaacacucgaaauuaucacuaacaaccgaagaauuagaagcucgggagcuuaaaaauaucaucccauuacucaagaaaaaugcccuacgcaauccagucgucgagaaaauacuaaaccaaaugauaaaugucguaaaugcguuaauugagaaaaauucagaaagggaugcugaagguaaaauaacaaaauacuuucacuucgaugaaauacgaauagaacuagccagagaacucaagaaaaacgcgcaaaaacgauacgaaaugacacaaaacauaaacaaagcaaaauccgagcaucagaaaauaagcgaaauuuuacaaaaagaguuuggaaucaaaaauccuaccaaaucagacauuauacgauauagacucuacaaagaacuagagcauaacggauauaaagaacuauacacaaauaccuacauugcacccgacguacuuuucucaaagaacauugauauagaacacauaguacccaaagcacgcgucuuugaugauuccuuuagcaacaaaacgcucgcuuucaaagauuucaauaucaagaaaggagaaucaacagcuuuugauuauauaacaucgcuuaaaaacgaagaaaaauuaaaccaguaccuagcuagaguugaaaacgccuauaaaaccaaaaacauaagcccugcuaaauacaaaaacuuacuaaagaaagccagcgaaauaggagacgguuucauaaacagagaccuaagagauacucaauauauagccaagaaagcaaaggaaauacuauuccaagucaccaaaaauguacuaucaacaagcgguuccauaaccgauagacuacgcgaggacuggagccucguagacguaaugaaagaguuaaacaugccaaaauaccaaucccugggucuuacagaaguugaagaaagaaaagauggaaacaaaguaaccguaauaaaagacuggacuaagcgaaaugaccaucgacaccacgccauggacgcacucacuguagccuuuacgaaacccagcuauauccaauaucuuaaucaccuuaaugcaagaaaagaugaaaauaauaagaauuacagcguaauacuagcuauugagaaaaaggagacaauaaagguaccuacaaacaacggcaaaaauaaacgaguuuucaucgaaccaauaccaaacuuuagacaaguagccaagaaacaccuagaagaaaucuucauaagccauaaagccaaaaauaaaguaguaaccaaaaacacaaauaaaccagcaggaacaaacaaacaacaaauaacacuaacaccgagaggacaacuucacaaagagacaauauacggaaaauaccaauacuaugucaauaaagaagaaaaagugggugucaaguuugacaaagaaacaauagcaaaagugucuaauccucuauaccgagaagcauuacugaaaagacuucaagccaaugauaacgauccaaagaaggcauucacaggcaaaaacgcacuuaguaaaaacccaaucuacuuagaugaagcaaaaacgaaaacguuacccgaaaaaguuaaccuaacuuaccucgaagaagauuuuuccguuaggaagaaaauaguccccaaaaauccuacaagcaaagaauuuguaccuaaccuuaaaagcauugaaaaaguaguugacgaagguguacgaaauauacuaaucgaacgauugagagucuauaauaaugaccccgagaaagcauuuguagacuuggaaaagaaccccaucuggcuaaauaaagagaaagguauagcaauaaaacgcgucacuauaucaggaguaaacaacgcacaaccacuccacauaggaaaagaccaucuagguaaaacaacacuaaacaaagagggaaaagaaauaccaguagacuauguuucaacaggaaauaaccaucacguggcgauauauagagacaaggaaggaaaucuacaagaacaaauugucucauucuuugaagcagugguaagaacucaacaagguuuacccaucauugauaaaacuuauaaacaggaagaaggauggcaauuucuauuuacuaugaaacagaaugaaauguucguauucccaaaugaagccaccgguuucaaccccgcggaaaucgauuuacucgaccccaaaaacaagaaacaaaucucaccaaauuuauuccguguucagaaaauagcaacaaaagacuauuucuuucgacaucaucuugaaaccaaugucgaaacagauaacguccuuaaaaacacaacauggaagcgcgaaggacuaucuggucuaaaagauaucguuaaaguaagaauaaaucaucuaggggauauaguaucuauaggugaauacuga

SEQ ID NO: 9153 - RNA, 4302 nt, Artificial Sequence
  Cas9 variant
augaaaaaaaucuuaggacuugacuuaggaacuacaucaauaggauacgcccaaguaaacgaaagugaggauuucaaagauuccucaauagaacgaauaggaguucgagucaauccucucucaguagaugaacaaacaaauuucgagaaaggcaaaccaauuucgauuaacgcagacaggacacugaaaagcggggccaggcgcacgcucgaccguuaucaagauagaagaagcaaucuaauugaugcacucguuaagucuguaauaaucacugaagauacaguguuagccgaagauggcaaaaauacuacucacuccacuuuugcauuacgagcgaaguccgcuagcgagaaaguggaaaaagcugaauuugcaagaauccuuuuagcaauuaacaaaaagcgcggcuauaaaagcaguaggaaaacuaacaauaaugaugacgaaggacaagcaauagacggaauggcaauagcaaagaagcuuuaugacgaaaacuuaaccccaggacaauuagcauaccaacuauuaaaagagggaaaaaaauauuugccggauuucuacagaucagaccuacaagcagaauuugacaaaaucuggacguuccaaaagcaauuuuaucccgagauucuaaccgacgaacuucaaaaagaauuagcgggaaaagggcaacgagccacaagugcaauauucuggaaaaaauacgacuuuaacacagcagagaacaaaggaaccagagaagaaaaaaaauuaaaagcauacgaauggcgauccacuagcguagacaaaaaauuacaaaaagaagaaguugcuuauguaauaacagaaauuaauaauaaccuaacaaauaguucgggcuaccucggagcaaucucagacagaucaaaagaauuauacuucaauaaacaaacaguagggcaauacuuauuuaagcaaauacaaaaaaauccacacacaaaacuuaagaaucaagucuucuauagacaagacuauuucgaugaauuugaaaucauaugggaaacacaagcaaaauuccauccagaauuaacagaagaacuaaaaaauaagauaagagauauaauaauauucuaccaacgaaaauuaaaaagucagaaaggacuuauuuccuuuugcgaauuugaaagaaaagaaguugaaauagaaaaaggaggaagacguaugaaaaaaacuaucggauuaaaagucgccccaaaaucguccccacuguuucaagaauucaagauuuggcaaguacugaauaauguacuaauaagaaaaaaaggaucuaaaaaaagacgagucaaggagccagaucaacuaaaccuaguggagcaggaacaagaaguaauguucuucgacaugcaaacaaaacaaacccuauucgacgaauuaaacgucaaggguaaucuaaaagcaaaacgaauaauagaacucauaggacaagaugcaaacgacugggaaauaaauuauucagaaauagaagggaaccgaacgaauaaagccuuguaugacgccuaucuaaaaauucuagacuuagagggauacgacacaaaagcccuucuagauguaaaaacgucuaaggacgagguagaauuagacgauauuaauauaucaggcccugaaguaaaagauuuaguuaaaagaauauucgaaaguuuagaaaucgauacccaaauauuagaguucgaugcagaacucgauggagaaguuuucgaaaaacaaagcagcuaucuacucuggcaccugcuauacagcuaugaaggagaugacucuccaucaggaaacgaaaagcuauauaaauugcuaaaacaaaaguucgguuucaagaaagaacacgcacaaauacuagcgaguaucacccuaucugacgacuauggaagucuuucagcaaaagcuaugcguaagauauacccauacauuagagaacaaacuuuugauaaagcugcaucacuagccggcuauagacacucugcgucauccuugacaaaagaagaaaucgcaaaucgcccacuaaaagauaaacuagaacugauaaaaaaaaauucauuaagaaacccuguaguagaaaagauacuaaaucaagucguaaacauagugaacagucuaauagaagcgaacuccgaaaaagauucagacggcaacauaauaagcuauuuuaaauucgaugaaaucagaauugagcuugcacgagaucuaaaaaaaaaugcaaaagaacgagcagaaaugacauuaaacauaaacgccgccaaaauaguacaugaaaagauuuucaaacuguuacaagcagaauucggcgucaaaaaucccacacguaacgauauaauacgguacaaacuuuaugaagaauuaaaaaauaacggauacaaagauuuauauaccaauauauacauaccccgcgaaauacuauucaguaaacaaauagauauagaacauauuauuccucaaagcaaaauguucgacgacaguuuuucaaacaaaacaauuguauuuaggaaagacaacuuagauaagggcaacaguacagcuuuugacuacauagauuccagguucggaaaggauaaacuaacggauuucgaacaaagaaucgaguucuuauuugaacaaggaaaaaaaaacaaagaggagggaauaagcaaagcaaaauaccaaaaauuacuuaaacgugaagcugacaucggugacggcuucauagaacgcgaccuaagagacacacaauauauagccaaaaaagcgcgcaaccuacuauaugaaauauguaggauaguaacuccaacgacuggcagcauuacugauaggcuaagagaagacugggaccuaguaaacauuaugcaagaacucaacuuagauaaauucaaaaaacuuggccucaccgaaaugguagaaaaaaaagacggaucauuuaaagaacguaucguagacuggucuaagcgaaaugaucauagacaccacgccauggaugcacuaacaauagcuuucacaaaacacagccacauucaauaucuaaacuauuuaaacgcaagaaaaaacgagaaucacaaacaacaucacaacauaaucggaauagaacgcaaagaaacagaguucgucauagaugaccucggaaacaaaaaacguaaauuucacuugccacuucccaauuuuagagaagaagccaaaaaacaccuagaaaacgucuuaguaagcuuuaaggcaaagaauaaagugguaacaaaaaauaaaaauaagaccgcuucaucaaaaggagaaaaaauaaaaguagaacuaacuccacgcggccaacuacauaaagagacaguauacgguaaguacaaauucuauguuagcaaagaagaaagaauaggcggaaaauucgaucaacguacgauugaacgcguagccaauuccacucauaagcgauuauuauuacagagauuacuugagaaugacaacgacgcaaaaaaagccuuuacaggcaaaaacgcacucgcaaagaaccccauuuauuuagacgacacuaaaacgcuaacuuuaccagaaauaguuaaauuaacauggcuggaagaagauuauuccauaagaaaagacauaacacccgaaaacuucaaagacaucaaaguaauagacaaaauacuagaugaaggaguaaagagaauacucaaagaaagguuagcaaaacauaacaauaacccaaaagaagcuuuuagcgaccuagagaaaaacccgaucuggcuaaaugaaaaaaagucaauaucaaucaaaaaaguaaaaauaagcgguauuaauaaugcugaagcccuacacuauaaaaaaaaccaccugggaauagagauuuuagacgaugaaaaaaaaagaauaccagucgauuucgucuccacagggaauaaccaccauguugcaauauauagagaugaaaaaggaaacuuacaagaagacguugucucguuuuuugaagcaguugcgagaguaaaccaaaacuugccaaucauagacaaaacguuaaaagccuaucuaggauggacauuccuauucacaaugaaacaaaaugaauauuucaucuuuccaaacaaacaaacuggauucaaccccaccgaaauugaccuacuugacaguaugaauaacaaacugauauccccuaacuuauuccggguccaaaaauucacugucaaagauuauuuuuuccgucaccaccuagaaaccaacguggaagacgauagcaaacuuaaaaacacaacauggaaaagagaaggacucggcggaauaggaaacauaguaaaagugagaauuaaccauauagggcaaauuguuaaaauaggugaauauuga

SEQ ID NO: 9154 - RNA, 4305 nt, Artificial Sequence
  Cas9 variant
augaaaaauauccuuggguuagaccuagguacuaacaguauaggaugggcauauguaaaacaagcacaaaaugauucggaaaaaucagaaauagcugagcuuggagugaggguaaacccucucaccguagacgagaaaaccaauuucgaaaaagguaaaccaauuucaacaaaugcagacagaacgcuaaaacgcggagcaaggaggaauuuacaacgauacaaauuaaggagacaagaauugauagagcucuuaaaagauuaucaaguaauaagugacaagacaauacuugcagaagaugggaaggaaacaacguucgagacauuaagacuacguguaaagagugcaaaggaacaaguaagccuagaagaacuagcaagaauacuuuuaaugauaaacaagaaacgaggauauaaaucaaguagaaaagcuaaaaacgaagaugaaggacaauuaaucgauggaauggaaauagcaagacgacuauacgacgaaaaucuaacuacaggccaauuaagucuacaacuacuuaaagaagggaagaaaucucucccugacuacuaccguagugaccuacagcacgaauuagacaaagucuggaauuuucaaaaacaauuucauccagacauucucacagaugaguucuacacuucaauucaggguaaaggacaaaaagcaacccgggaaucguuuucguccaaauaugguauagauacugcagaaaauaaaggauccagagaagaaaagaaauuacaggcuuaucaauggagagcugaugcgacacauaaagaacuaacaaaagaagaauuagccuuuguaauuacagaaauaaacaauaacauuaacaacagcagcgguuauuuaggugccauaucagaccgcaguaaagagcuuaucuuugcaaaugaaacagucggagaauaccuauggaaacaaauacaaaacgauccacacacaucguugaaaaaucagguauuuuacagacaagauuauuuugaugaauuugaacggauaugggaaacacaaucaggauuuuauccacaaauauuaacagaauccuuaaagaacgaacuacgagacaucuuaauauuuuaccaacgaaaacuaaaaucucaaaaagcguuaguauccaucugugaguucgaaagcaaagaaauaccauuaaaagauaaacaagggaauccaauaaguaaaaacggcaucccaguaacuaaacuuguaggaccgaaaguugcuccgaaaaguucaccucuauuccaagaauuuaaaauauggcaaaauuuaaacaacguucuaguuagaccaaaaggaucacgaaaaagaaaaguaacaacaaaccaacaauccacacucuuagaaggacaagaaccgguauuugagcugaacuuagaacaaaaagaauuauuauuugaagaauuaaaucuuaaaggaaauuuaaaaacagacuacugccuagaacuaauuggcuauagcgcaaaagaaugggaaaugaauuacccaacgcuagaaggaaauaaaacaaauaaagcacuauacgaggcuuauuuaaaaaucaucgauucagaaggcuaugacgcuaaaaagcucuuaaaagucaaaaccgauaaggacgacaucaaucuugaugauauaaaaguaagcgcaagcgaaauaaagacgaugauauccgauauauucaaugaguuaggaauaaauacaaaaauacuagauuucgacgcggaacucgaaaggaaacaauuugaagcucaggcuucuuaccgguuguggcaccucuuauacucuuacgaaggagacgauucaaaaagcgguaacgaacuacuauaucgcuuacucgaggauaaauucggguuuaaacgagagcauucaaaaacacuugcaaauguaagccuucuaagcgacuaugguaaccuaucaaccaaagccauccgaacgauauauccuuacaucaaagaaaacaaauuuagcacagcaugugaauuagcagguuacagacauucaaaauugaguauauccaaagaagaaaacgaaaacagaacuuuaaaagacacacuagacguacuaaagaaaaacuccuuaagacaaccagucguagagaaaauacuaaaucaaaugauuaaccuaauaaaugaacuuauagaaaaacauagcgaaaaagacgaaaaaggaaauaucguaaaauacuucaaauucgaugaaauacacaucgaacuagcacgugaacugaagaaaaaugcagaagaaagaagagaacucgacucaaaagucagagaaggaaaagacagaaaugagaaaauaauuacaauacugaaaucagaguucggccucccuuacccuaccaaaaaugacaucacacgguaccgauuauacgaagaacuaaaagacaaugguuacaaagaccuuuauacaaauaccuacauccccagagaaaaacuuuucucuaaagaaauagacauagaacauauaauuccaaaaucacgacuauucaacgacuccuucaguaauaaaacaaucuguuacagacaagacaaccuaaauaaaggcgaacgaacagcauaugauuacaucgaaggauuaggaaaaacccaacuagacgaauaccuaaaucgcguagaaaaucuauacacuaauaaauuuauaacuaaagcuaaauaccgaaaccuacugaaaaaggaaagcgaaauaggggauggcuuuauagaaagagaucucagagaaacucaauacauugcaaagaaagcaaaagaaauguuacuccaaauaacaagacaugucguaucuacaaccggaucaaucaccgaccgcuuacgcgacgauugggaauuaguuaauguaaugagagaacuaaaccuaccuaaauacaaaguacucgguuugacugaaauacaagaaaggaaaaaugggcaaacaguagaaguaauaacggauuggacaaaaagaaacgaccauagacaccacgcaauggaugcacuaaccguagcguucacaaaacacagccauauacaauaucugaacuuuuuaaacgcacgaaaagacgaaaaacauaaggaauacuccaacaucaugggcauacaacaauuagaaacugagaaaacaacugauaaagauggaaaagaccgacgagucuuuaagacuccaauaccuaacuuccgccagguagcaaaagaacauuuagaaagcauacuuaucagccacaaaaccaaaaauaaaguaguaacaagagcaacaaacaaaauugcaggaucaaagaaacaacaagaaacacugagcccacguggacagcuacacaaagaaacagucuauggcaaauaucgacgauauguacaaaaagaagagaaaauaggaucuaaauucgaccuacagacaaucgaaagagucgcaaacccucucuacaaacgguuacuaacuaaaagacuagaagaaaauggaggugacccaaagaaagcguucacuggcaaaaaugcgcuggccaaaaguccaauauacuuagacgaaacacaaacccaacaauugccagaaaaaguuaagcuaguauggcuagaaaccgacuucagcaucagaaaagauauaaccccagauaauuuuaaagaugaaaaaucuauugauaaaguacucgaugaaggaaucaaaagaauuuuaaaagaccgauuaaaaucauucgauggagaugccaaaagagcguuuaccgaccucgaacaaaacccaaucuggcuaaauaaagaaaaaggaauagccauaaaacgugucaccauaucgggaguuaguaacgccgaaccacuacacacaaagaaagaccacuugggaaaugaaaucuucgaugauacagggaaaccaauaccaguugacuacgucucuacuggcaacaaucaccacauagccaucuaccgcgaugaaaacggaaaucuucaagaaaaagccguaucauuuuucgaagccguaacucgggccaaccaaggccuaccaacuguugauaaaacguacaaccaacaucuaggauggcaauuucuauucacaaugaaacaaaacgaaauguuugucuuuccaaauaaagaaacaggauuugacccccaggaaaucgaucucuuagauccgaaaaauaagaaacucauaucaccaaaccuguuccgcguacagaaaauuucaaccaaaaacuacuucuuccgacaucaucuagaaacuuccguagaaacacauaacgcccuaaacggcguaacguauaaaucacaacucgguuuaaauggaauaacagauauuauaaaagucaggaucaaucaucuaggcgauauagugcauauaggcgaauacuga

SEQ ID NO: 9155 - RNA, 4308 nt, Artificial Sequence
  Cas9 variant
auguuaggaugcgaaagaaaaaggaaaagacgagaaaaagaaaaaauggcaaaaccaaaagacuauacaauuggacuagauauuggaacuaauucuguaggauggguaguuaccgaugaccaaaacaacauauuaagaauaaaaggaaaaaaagcaaucggcgcucgacuauuuaccgaaggcaaagucgcagcugaacggcgauccuuuagaacaacuagaagaagacucaguagacgaagauggagaauaaaaaugcucgaagaacucuuugacgaggagauagcaaaaguagaccccagcuuuuucgcaagacuccacgaaucauggauuaguccaaaagauaaaaggaaacgcuacucagcaauaguuuuccccucaccagaagaggauaaaaaauuccaugaauccuaucccacaauauaccaccuaagagauaaacuaaugaaagacgaccaaaaacacgacauucgagaaauauacauagcaguacaccaaaugauaaaagcucggggaaacuuccuucaugacgaaaguguagaaacuuacagauccggaaugagcagucuaggagguagaagugagcgaaauauacuaucugugcagacauuggaagaacuaaacgaccucuucgccgaaaacgaaggaacagaagaaguagaacuaaauguggccuccgcggaacaaaucaacgacauauuaaccggaggucacuuaaacgcagacucacaaaaagaaauuucuaaucuauuauuacccagcagcuucccaucuuuugaugacaaggcaaaagaaaaacaagucaaaaaauugauaaauaauguugccacaaauaucuccaaagcaugguuaggcuauaaagcugauuuuuccacgauuuuaaaccuagcaaaaguugauaaggaucagaaaaaaauauuugccuuugcacuacaaggaggugaugaagaggacaaaguccaagaauuagaaucauuauuagagcaaucacaaacagacauaguagaucgcuuaauagaaauaagacaugccauaguccucucagagauugucccagucggaaugaccuuaucagaagccaugauagacaaauacgaucaacacaaagaagaccugauuacacuaaaagcugucauacgaaauacaaaagacaaaaaaaaagccgccaaauuacaagcgaucuacgaccuauacguuaaaaaucgacacgcugauuuagcaaaagcuaugaagcuaacaggcaucaaaaaaagaucagaacuacuagaccccgaagaacugaaaaaaggcaucucgucucuauuggaugacucaccagaagcggucgaaauuaaacaaagauuagaagaaaagacuuuccuaccacuacaaagaagcaauaacaacggagugauuccaaaucaauuacaccaagucgaauuggaugaaauaaucaaaaagcaaagcaaauacuauccauucuuggcugaaaaaaaucccgaugagucagaagaagcacaaaaaaaagccccaacuaaacuugaugcucuguuaacuuuuagagugccauacuacguaggcccaaugaucacgaaagaagaacaagaagcacaaaauggacacucauuugcguggaugguaagaagagacccccaagaccacgaagccauaaccccuuggaacuuugaaaaaaaaguagacaaaauggccagugcuacacaguucauaaaacguaugacaacaaaggacacauauuuacuaggcgaagacguacuuccugcaaguucauuaaaauaucaauuauucacuguacuaaaugaacuaaauaaucuaagagucaacgguaagaaacucacaagugacgaaaaggaacaagucauugaaggauuguuuaaaaaacaaaaaacaguaaaagcagacaaauucguaaaauauuggcaagcaaagcacauuggagcagauauaaaaguaaaaggacuaucugacccaaguaaauuuaacucuaccaugucaacguauauagacuucaaaaagaucuucggcgaccaauuaaacgauguuaaucgacaaaacgacuucgagaaaauaauagaauauucaacaauauucgaagacagaaaaauacuagaagacaaacuaagggucgacuuugcauggcuaagcgaagaacaaauuaaacaauuaugcagacuuagauugcaaggaugggggcgacugucggacaaguuauuaaccagacuaacagacgcugacggccaaaacguuuuagaaaggcuauggaacuccaacgacaauuuuguacagauaguuagcgaucccaacauaaaagccaaaaucgaacaagagaaccaaaaauugcuucgagacucucaaagcgauaacgcaguggaaagcauucuggacgacgccuauacaaguccacaaaacaaaaaagcuaucagacaaguaaugcgaguaguucacgauaucguuaaagcaugcgauggaaacgugccagcaaaauuugccaucgaauuugcgcguagucaagaagaugacccaaaaagaacuacagcaagaguuaaucaaaugcaaaaaaucuaugaccagauaagugaugagguggucucacaaggagucaaagaacaacuaucgggcaugaaaucacuaaaagacagauauuaccuauacuuuaugcaaggaggaagggacgcauacacaggagcgaaauuaaacauagauaggcuaagcgauuacgaugucgaccacauaaugccccaaucauucguaaaagacgauaguuuagacaacagagugcuagucgcaagagcuguaaacaaccaaaaauccgauaaaguaccagcucuauuauucggaaauaaagucguggccgaucucgggauaacaguaagagaaaugugggacaaauggcaaaaguuagguaugauaucaaaaagaaaacucaguaaucuuuuaaccgauucagaugcacucacugaauacagagcacaagguuuuaucagaagacaauugguagaaacaucccaaguaauaaaauuaaccgcaaccauacuacaaagcgaguucccagauucaaaaaucauugaaguaccagccaaauauaauucaauaguuagaaaacaauuugaccuuuauaaaucacgagaaguuaacgacuuucaccacgcaauugacgccuacuuaucaaccauaguuggaaacuaccucuaccagguauauccaaaucugagaaggauguucguguauggagaauuuaaaaaauuuaguagcaaugcagaggaaucagcucacgacguagcccgacguguuaaaucuaugaauuuccuagaugauuuauuaagaggaacacacggagauaacauuuauugccguuccacaggugaaaucguguucaacagaaaugacauuauaaguaaauugaaacaggcguacaguuucaaacaaaugcuuguaacucaagaaguuuuuacaaagaaauccgcccuauuuaaucaaacuguuuauccaucacccaaaagagacgguucaaaacggagcggacucaucccacguaaaagaggaauggacccagaaauauacggaggguacgcccauaaucaagauuccuacuuuguccuagcaaaaaucgaaaaagucaaagguuacacgcugcaaauaguaggggucccaauacgaagccucgaaauuauaaauaaagcugaagacuuuucaacugcauuacucgauauuauaaaaucaaaagucauguauaaugaaaagacuggacaaccaaaacgugggaucaagaauguagagauauuaguuaauaaacuuccauaucgacaaccuauauuagaaaaagacguaaguuauauguuagguucuagugcauacaaguacaauauuaaacaaauuacucuuucaagacaauccaugaaauacauacuagacuacaucgacgacccgaacuuuacgaaacacgagaugacaaugauagacgagcagaacgaaagagaaugucuucuuagcgucuacgaugagauacuagaaaaaguagacaaauaucuaccucuguuugauggaaauaaauuucgcgaaaaacuccacuccgcacggaaagaauuuguaucauuaagcguugaugaugaagcaucugcaauagaaaagauacucagaggccuacaugcaaauagcgaaaugcccucgcuagaaaaccuuaaaauaaaaccagcacuaggauucuuccaaaugaaaaacgguauaacacucucuaaugaugcaguccugcuuuaucaaucucccacagguuuguuugaacgaagaguaaaagucagcgaucuacuaaaauga

SEQ ID NO: 9156 - RNA, 4308 nt, Artificial Sequence
  Cas9 variant
augaaaaacauacuuggauuagacuuaggaacaacaucaauugguuucgcccauaucguagaggaugaaaauaaagaaaaaucugaaauaaaagaacucgguguaagaaucgugccuuuaacaaccgaugaacaaucugauuuugaaaaaggaaaauccauaaccaccaaugcgaaccgcacuuuaaaacacggagcaagacucaaucuagacagauaccaacaaagaagaaaauauuuaaucgaccuauuacaaaaagcaaaccuaauaaccagcucaaguauacuagcagaaaacggcaaaaacacgacacauucaacauggcaacuacgagcaaaagccguaacagaaagaaucgaaaaagaagaguucgcgagaguauuacuagccauaaacaagaaacgaggauauaaaagcagcagaaaagcaaaaacagaagaugaaggucaagccaucgacggaauggcaauagcaaaacgauuauaugaugagaaucuaacaacaggucaacuuucauugcagcuccuacagcaaaauaagaaauugcuaccagacuuuuacagaucggaccuacaaaaagaguucgaccucguauggaacuuccaaaaacaauuuuauccagacauccuaacagacaguuucuacaaagaacuccaagggaaagguaaagaugcaacaucaaaagcauuuucuaaacguuaucauuuugauacggcagaaaauaaagguucaaaagaaucaguaagacuacaggcuuaucaauggcgugucgaagcgaucuccaaacaacuaagcaaggaagaaguagcguauguccuaacagaaauaaacaacaacuuaaauaacgccuccggcuacuuaggugcaaucucagacaggagcaaggaacucuauuucaaccgccaaaccguaggucaauacuuguaugcacaauuacaagagaacagacacaacucacuuaaaaacaaaguauucuacagacaagacuaucuagacgaguucgaaagaauaugggaaacacaggcuuccuuucacaaagaacuaaccgaagaacucaagaaacaaauucgagacguagucaucuuuuaucaacguaaaccaaaaucacaaaaaggcuuaauaucauuuugugaguucgaauccaaagaaaucgaaauagaaaaagacgguaaaacuauaacaaaaaccaucggagcuagaguugucccuaaaucaagcccauuauuucaagaguucaaaauauggcaaauacuaaacaacguuauaugcaaacgaaaaggcauaagaaagaaaaagguaucugcaaaaacuacgcaauuagaccuauuaaaugaaaguucacaaacuauuuucucacuagauauggaaugcaaacaauuacuauuugaagaauuaaaucucaaaggagacuugaaauccgauaaaguauugaaacuacuagguuacaguccccaagaaugggaaauaaacuacaaccaacucgaaggcaacagaacgcaaaaagccuuguacgaggcauauuuaaagauugucgaaauggaagcacaugauguaaaagacauacuucaaaucaaaucagcuaaagaugacuggucacuagacgaaucgcccuuaucugcgucugaaaucagggaaagcguaaaagcaauauuccaagcacuaggaauaugcacgaaaauacuuuacuucgauccucuccucccaguaaaagaguucgaaaaacaagauucauaucaacuauggcaucuuuuauauagcuacgaaucagaugacaguacaaguggcaacgaaacauuauaccgcauacuagaaaagaaauaugcuuuuaaacgagaacaugugcgcauuuuagcaaacguagcacuacaagacgauuacggaucacuauccacaaaagccauucgaaaaauauauccaaacauaaaagaaaaucaauauuccauagcaugugagauggcuggcuacaaacauucaaaacugucauugacuacagaagaauuagaagccagggaacugaaaaacauaauaccccuacuuaagaaaaacgcguuaagaaacccaguaguagagaagauauuaaaucaaaugauaaacguaguuaaugcucuaauagagaaaaauagcgaacgagacgcagaaggaaaaaucacaaaauacuuccacuucgacgaaaucaggauugaacuagcacgagaacucaagaaaaacgcacagaaaagauacgaaaugacacaaaauauaaacaaagcuaaauuagaacaucagaaaauaucagaaauacuacaaaagcaauuuggaauuaaaaacccaacaaaaagugacauaauacgauacagacuauaucaagagcuugaacacaacggauauaaggaauuauauacuaaugcauacauagccccagauguccuauucucuaaaaacauagauauagaacauauagugccuaaagcccgaguguucgacgacucuuucucaaauaaaacauuggcauucagagaguucaacauaaagaaaggcgaauccacugcauuugauuacaucacaagucucaauagugaggaagaauuaaaccaauaucuaacccgcgucgaaaacgccuacaaaacaaaaucaauuaguccgacaaaauauaaaaaucugcucaagaaagcaucagaaauaggagacgauuucauaaacagagaucuuagagacacgcaauacauagcaaagaaagcgaaagaaauacuauuucaaguuaccaaaaauguucucagcacaucagguaguauaacagaccgcuuacgagaagauugggguuuagucgauguaaugaaagaacuaaauaugccuaaauaccagucacuaggucuuacagaagucgaagaacgaaaagauggaaacaaaguaacaguuaucaaaaauuggacaaaacgaaaugaccauaggcaucacgcuauggaugcucuuacuguagcauuuacaaaaccaaguuacauacaguaccuaaaccacuugaacgcacgaaaagaugagaauaacaaaaacuacuccguuauacuagcaauagaagagaaagaaaccauuaaagucagaacuaacaacgguaaaaacaaacggguauuuauugaaccaauaccuaacuuccgacaaguagcgaagaaacaucuggaagaaaucuucauaagucacaaaaccaaaaacaaagucguaacuaaaaauguuaacaaaccagccggaacagauaaacaacaaauaacauuaacaccaagaggacaacuacauaaagaaaccauauauggaaaauaccaauauuacguuaauaaagaagagaaaaucggaguaaaauuugacaaagaaacgauagcaaaaguuagcaauccacuauaucgcgaagcucuccucaaacgcuuacaggcgaaugauaaugaccccaagaaagcauucacaggcaaaaaugcccuaagcaaaaagccgauauaccuagacgaaucaaagacgaaaacacuaccagagaaaguaaauuuaacguacuuagaagaagauuuuagcaucagaaaagacauuaguccagacaacuuuaaagaccuuaaaucuauagaaaaaguaauugaccaaggaguaaaaagaauacuuaucaaaagacuucaagcauaugacaacgaccccaaaaaggcauucguagaccuagagaaaaauccaauauggcugaacaaagaaaaaggaauagcuauuaaaaggguaaccaucagcggaguaaacaacgcgcaaccauugcacaucggaaaagaccaucuaggcaaaacaacucuaaacaaggagggaaaagaaauaccaguagacuacgucuccaccggcaacaaucaccauguugccauuuaccgcgauaaagaaggaaaccuucaagaacaaauaguuaguuucuuugaugcaguaguacgugcccagcaaggauuaccuauaauugacaaaaccuauaaacaagcagaaggcuggcaauuuauguuuacaaugaaacaaaaugaaauguucguauucccuaacgaaacuacuggauuuaaccccgcggaaauagauuuacucgacccgaagaacaagaaauuaaucagccccaaccucuucaggguucaaacgauaucaguugucaaauacgggaauagugucguuagagacuuuaaauucagacaucauuuagaaacaaccuuacaagaugacaaaauacuucaaggcaucacauuucaacaaauuaaaagucucgaaccucugagaaacaucguaaaagucagaauaaaccaucuuggugacaucguaucaauaggugaauauuga

SEQ ID NO: 9157 - RNA, 4308 nt, Artificial Sequence
  Cas9 variant
augaaaaauauccuaggccuugaucuuggaacgacaaguauaggauuugcacauauuguagaggaugaaaacaaagagaaauccgagaucaaagaacuagguguacggauaguaucuuuggccaccgaugaacaaucagacuucgaaaaagggaaaagcauaucaaccaacgcuaauagaacucuaaaacauggcgcaaggcuaaauuuagaccgauaucaacaaagaagaaaauucuuaauagaccuccuacaaaaagcaaaccuuaucacuucagcauccauacuugccgaaaacgguaaaaauacaacacacagcacauggcaauugcgagcaaaagcaguaacagaaagaauugaaaaagaagaauucgcaagaguacucuuagcuauuaacaaaaaacgaggguauaaaaacagcaggaaaacuaaaacggaagaugaaggacaagcaauagauggaauggcuauagcaaaaugucuuuacgaugaaaauuuaaccccggggcaacuaucgcuucaacucuuacaacaaaauaaaaaacuacuaccugacuucuacagaagcgacuuacaaaaggaguucgaucucgucuggaaucuacaaaaacaauucuacccagauauucuuacggacuccuuuuacaaggaacuacaggguaaaggcaaagaugcaacguccaaagcuuucaguaaacgauaccacuucgauacagcagaaaacaaaggcucaaaagaaaguguaagacuacaggcauaccaauggcgagcagaagcaaucucaaaacaacucucaaaagaagaaguagccuacguauuaaccgagauaaacaacaaccuuaacaauucaucuggcuauuuaggcgcgauaucagacagaaguaaagaauuauacuucaaucgacaaacaguaggacaauaccuauacgcucaauuacaagaaaauagacauaauucguuaaaaaacaaagucuuuuauagacaagacuaucuugacgaauucgaaagaauaugggaaacucaagcaucauuucacaaggaacuaacagaugagcuuaagaaacaaauccgggauguagucauauucuaccaaagaaagcuaaagucccaaaaaggauuaguaagcuuuugcgaguucgagagcaaagaaauagaaauugagaaagaugguaaagcaaucacaaaauccaucggugcaagaguugucccuaaauccucaccauuauuucaagaauuuaaaauauggcaaauucuuaauaauguaacauguaagagaaaaggaauaagaaaaaaaaaaucaucggccaagucuaccgaacuugaucuguuuaacgaaccaucccaauccauauucucacuagacauggaaugcaaacaauuacuuuucgacgaauuaaaucuaaaaggcgaucuaaaauccgauaaaguguugaaacuauuagguuauucaccacaagaaugggaaauuaauuacaaucaacuugaagggaauaggacucaaaagucuuuauacgaagcauauuuaaaaauaauugaaauagagggauaugaaguaaaagauauccuacagauaaaaucaacaaaggaugauuggucacuagacgaaucaccguuaagcgcaagugagaucagagaaagaguaaaaguuaucuuucaaacauuagguauauguacuaaaaucuuauauuuugacccauuacuuccaguaaaagaauuugagcaacaauacaguuaucaacuauggcacuugcuuuacucuuacgaauccgacgacagcacauccggaaacgaaacacucuaucgaauacuagaaaaaaaauacgcuuuuaaacgagaacacgcgacuauacucgcaaacguagcgcuucaagaugacuaugguucacuaucuacaaaagcuauacgcaaaauauacccuuacauaaaagaaaaccaauauucaacagcuugugaacuggcagguuauaaacauucuaaacuaagucucacaacggaagaacuagaagcccgcgaacuaaaaaauauaaucccauuacucaaaaaaaaugcauugcgaaaccccgucguagaaaaaauacuaaaccaaaugaucaacguuguaaaugccuuaauagaaaaaaauagcgagagagacgcggaaggcaaaauuaccaaauacuuccauuucgacgaaauaaggaucgaacuagcccgcgaauuaaagaaaaaugcucaagagcgauaugaaaugacccaaaacauaaacaaagccaaauuagaacaucaaaaaauaucagaaaaacuucaaaaacaauuuggaauaaaaaauccuacaaaaagcgacauuauacgauacagacuauaccaagagcuagaacauaacggauauaaagaacuauauaccaacacguacauagcuccugauguccucuuuucaaaaaacauugacaucgagcauauaguaccaaaagcccgggucuucgacgacucuuucucaaacaaaaccuuagcauucaaagaauuuaauaucaagaagggagaaaguacugccuucgauuauaucaccaguuuaaacugugaaggcgaacuaaaccaauaccugacccgcguugaaaacgcauauaaaaccaaaucaauuagcuuaacaaaauauaaaaaucuacuaaagaaagcuucagaaauaggagaugguuucauuaacagagaucuaagagacacacaauacauagcaaaaaaagcaaaagaaauauuguuccaggucacaaagaacguacucucaacaucaggaucaauaacagauagacuccgugaagacuggggauuagucgacguaaugaaagaacucaauaugccuaaauaccaaagucuaggucuaacagaaguagaagaaagaaaggacgguaauaaaguaacaguaauaaaagauuggacaaaaagaaacgaccaccgacaccaugccauggacgcacugacaguggcauucaccaaaccaagcuacauacaauaucucaaccauuuaaacgcuagaaaagaugaaaacaauaaaaauuacaguguaauacuagcgauagagaaaaaggagaccauuaaaguucccauaaauaauggaaaaaacaaacgcguauucauagaaccuauacuaaacuuccggcagguggcaaaaaaacacuuagaggaaauauuuauaagccauaaagcgaaaaacaagguugugaccaagaacauaaauaaaccugcugggacugauaaacaacaaauaacucugaccccaagaggacaauuacacaaagaaacaauuuaugguaaauaccaauauuacgucaauaaagaagaaaaaguaggcguaaaauucgacgaaaggacaauaacaaaagucucuaacccucucuaccgagaagcacugcuaaaacgccuacaagcaaacgacaaugacccaaaaaaagcauucgcaggaaaaaacgcacuaagcaaaaaucccauauaucuagacgaagcaaaaacuaaaacuuuacccgaaaaagugaaccuaacauaccuagaagaagacuucaguaucagaaaagauaucucuccggauaacuucaaagauuuaaaaucaauugaaaaagucaucgaucaaggugugaaacguauuuuaauaaaaaggcuccaagccuaugauaacgacccgaaaaaagccuucguagauuuagaaaaaaauccaauauggcuaaauaaagagaagggaauugccauaaagagagucacaauaagcggagucucgaaugcccaaccacuacacaucggaaaagaucaucuagguaaaacgacacuaaauaaagaggggaaagaaguaccagucgacuauguaagcacaggaaauaaucaucacguggcaauauaucgagauaaagagggaaaccuccaagaacaaauuguaaguuucuucgaagcaguagugcgagcacaacagggauuaccuauaauagauaaaaacuacaaacaagcugaagguuggcaauucauguuuacaaugaagcagaacgaaauguucguuuucccuaaugaagccacaggauuuaauccagcagaaauugacuuacuagaccccaaaaauaaaaaauuaaucucccccaacuuguuuagaguacagaccaucucaauugugaaauacggcaauucaguagugagagacuucaaauuuagacaccaucuagaaaccacccuacaagacgacaaaauacuacaagguaucacuuuucaacagauaaaaucacuugagccacucagaaacauaguaaaagugagaaucaaccauuuaggugacauugugaacauuggugaauacuga

SEQ ID NO: 9158 - RNA, 4311 nt, Artificial Sequence
  Cas9 variant
augaaaagaauauuaggcuuagauuuaggaacuaacuccauaggaugggcccuaguuaaugaagcagaaaacaaagaugaacgcaguucaauagugaaacuuggaguucgaguaaacccccuuacaguggacgaacucacuaacuuugaaaaaggaaaaucaauaaccacgaacgcagauagaaccuuaaaacgaggcaugcguagaaaccuucaacguuauaaacuaagaagagaaacauuaacugagguauuaaaagaacacaaauuaauuacagaggacacaauauuaagcgaaaauggaaaccgcacaacauuugaaacuuacaggcucagagcaaaagcaguaacagaggaaaucucacucgaagaguucgcacgcguucuauuaaugauuaacaagaaacgaggauauaaaagcagcagaaaagcaaaagguguggaagaagggacacuuauugauggcauggacauagcuagagaacuauacaacaacaaccuaaccccaggagaauuaugcuuacaauuacucgaugcaggaaagaaauucuuaccggacuucuauagauccgaucugcagaaugaacuagauagaauaugggaaaaacaaaaagaauacuauccagaaauacugacggacgucuuaaaagaagaauuacgagggaagaaaagagaugcagucugggcuauaugugcaaaauacuuugucuggaaagaaaauuauacagaauggaacaaagaaaaaggaaaaacagaacagcaagaacgcgaacauaaauuagaagguauauacucaaaacgaaaaagagacgaagcaaaacgagagaaucuucaauggcgagucaauggacuaaaagaaaaacuaucucuugaacagcuaguaauaguauuucaagaaaugaauacucagaucaacaauaguucuggguacuuaggagcuauaagcgaucggagcaaagaauuauacuuuaacaaacaaacagugggucaauaccaaauggaaaugcuagauaaaaacccaaacgcuagcuuaagaaacauggucuuuuaucgacaagacuauuuagacgaauuuaauaugcugugggaaaaacaagcuguuuaccauaaagaacuaacagaagaauuaaagaaagaaauaagggauauaauaauuuucuaucaaagaagacuuaaaucgcaaaaagggcuuauagguuucugugaguucgaauccagacaaauagaaguagauauagaugguaaaaagaaaauaaaaacgguaggaaaucgaguaauaagccgaagcaguccucuauuucaagaauuuaaaauauggcaaauauuaaacaacaucgaagucacaguaguaggaaagaaacgaaaacgacgaaaacuaaaagaaaacuacucagcguuguucgaggaacuuaaugaugccgaacaacuagaauuaaacggaucacgacgucucugucaagaggaaaaagaacuacuugcucaggaacuguuuguaagggauaaaaugacaaaaagugaaguauuaaaacuccuauuugauaacccacaagaauuggaucuuaauuucaaaaccaucgacggcaacaagacuggauacgcauuauuccaagccuacaguaagaugauagaaaugaguggacaugaaccaguagacuucaagaaacccguagagaaaguuguagaauacaucaaagcaguauucgaucucuuaaauuggaacacagacauuuuagguuucaauucaaaugaagaauuagauaaccaaagcuacuauaaacuguggcauuuacuauauucguuugaaggcgauaauacgccaacaggaaauggaagacuaauacagaaaaugacugagcucuauggauucgaaaaagaauaugcgaccauucuagcaaaugugagcuuucaagacgacuacgguagcuuaucggcaaaagcaauacacaaaauacuuccacauuugaaagaaggaaacagauacgacguagcauguguauaugccggauaccgucacucagaaaguucauuaacacgagaggaaauagcaaauaagguacuuaaagauagacuuauguuacucccuaaaaacucacuacacaacccaguaguagagaaaauacuaaaccaaaugguaaacgucaucaacguaauuauagauauauauggaaaaccagacgaaauaagaguagaacuggcacgcgaguuaaagaaaaaugcuaaagaaagagaagaauuaacaaaaucgaucgcacaaacaacaaaagcccacgaagaauacaaaacccuacuacagacugaguucggauuaacaaaugugucacgaacagauauauuaagauauaaacucuauaaagaauuggagucaugcggauauaaaacccucuauucaaauacuuauauaucgcgggaaaaguuauucucaaaagaauuugauauugaacauauuaucccacaagcgagauuauuugaugauaguuuuagcaauaaaacauuggaagcuagaagcguuaacaucgaaaaaggaaacaacacugcauacgauuucguaaaagagaaauucggagaauccggcgcagauaauaguuuagaacaauaucuaaauaacauagaagaucuuuucaaauccggaaagauaucuaaaacaaaguacaauaaacucaaaauggcagagcaagacaucccagauggauuuauugaaagagauuuaagaaauacgcaauauaucgccaagaaagcccucaguaugcuaaacgaaauaagccauagaguaguagccacaucaggaucagucaccgacaaauuacgggaagacuggcaacucaucgauguaaugaaagaacucaacugggagaaauauaaagcauuagggcuaguugaauauuucgaagaccgagacggaagacaaauaggaagaauaaaagauuggacaaaaagaaaugaccauaggcaucacgcuauggacgcauuaaccguagcuuucacaaaagacguauucauacaauacuuuaacaauaagaacgcaagccuagauccaaacgcuaacgagcaugcaauuaaaaauaaauacuuucaaaauggacgcgcaauagcgccaaugccgcuccgagaguuuagagcugaagcuaagaaacauuuagaaaauacuuuaaucaguauaaaagccaaaaauaaggugauaacaggaaauaucaacaaaacacgaaagaaaggagggguaaauaaaaauaugcaacagacuccgagaggacaauuacaucuggaaacaauauacggauccggaaaacaauaccuaacaaaagaggaaaaagucaaugcuagcuuugauaugagaaaaauuggaacuguuagcaaaucagcauauagagacgcauuacuaaaacgacuguaugaaaaugacaaugauccuaaaaaggcauuugcaggcaaaaacucccuagacaaacaaccaauauggcuagacaaagaacaaaugagaaaagugccagagaaaguaaagaucgucaccuuagaagcuauuuauacaauacgaaaagaaaucagcccagaccuaaaaguggacaaaguaauagacguggguguucgcaagauacuaauugauagauugaaugaauauggaaaugaugcaaagaaggcauuuuccaauuuggaugaaaacccaauuugguuaaauaaagagaagggaaucucgauaaagagaguuacaauuagugguauaucgaaugcacagagcuuacacguaaagaaagauaaagauggaaaacccauuuuagaugaaaacggccguaauauaccuguagauuucgucaacacaggaaacaaucaucacgucgcagucuauuaucggccaguaauagacaaacguggacaacuggugguugaugaagccggaaacccaaaauacgaacuagaagaggugguaguauccuucuuugaagcagugacaagagcuaaccuaggucaaccaauaauagacaaagauuauaaaacuacagaagguuggcaauuuuuauucuccaugaaacagaacgaauacuuuguauuccccaaugagaaaaccgguuucaacccuaaagaaauugaccuauuggacguugaaaacuauggacuaauaucgccaaauuuauuuaggguacaaaaauucucauugaaaaauuauguauucagacaccaccuagaaacuacaauaaaagauacaucaaguauacuaagagguauaaccuggaucgauuuucgaagcucaaaaggacuagacacaauugucaaaguuaggguuaaccauauuggacaaauaguaagcgugggagaguacuga

SEQ ID NO: 9159 - RNA, 4311 nt, Artificial Sequence
  Cas9 variant
augaagagaauacuaggccuagauuuagguacaaacagcaucgguugggcauuaguuaacgaagcugaaaacaaagacgaaagaucgagcauaguaaaacuaggcguacgggucaauccacucacugucgaugaauuaacaaacuuugaaaaaggaaaauccauuaccaccaaugcagauagaacauuaaagcgaggaaugagaagaaaccuacaaagauacaaacugcgacgagaaacucuaacagaaguauugaaagaacacaaacuaauaacagaagacacuauacuaagcgaaaauggaaaccgaacuacguucgagacauaccgacuacgagcgaaagcaguaacagaggaaauuagcuuagaagaauuugcacgaguacuucucaugaucaauaagaaacgugguuauaaaucaucaagaaaagcaaaaggcgucgaagaggguacacuaauugacggaauggacauagcuagagaacuauacaauaacaaccuaacaccaggggaauuaugcuuacaacuauuagacgcaggcaagaaguuucucccugacuucuaccgaagugaucugcagaaugaacuggacagaauaugggaaaagcaaaaagaauauuacccagaaauucucacugauguguugaaagaagaacuccgaggcaagaaaagagacgcuguaugggcuauaugugccaaguauuucguauggaaagaaaauuauacagaauggaauaaagagaaaggaaaaaccgaacaacaagaaagagaacacaaacuugagggaaucuacucuaaaagaaaacgagaugaagcaaagagagaaaauuuacaauggagaguaaacggacuaaaagaaaaacuaagccuagaacagcuaguuauaguauuucaagaaaugaauacacaaaucaacaauucaaguggauaucuaggagcaaucuccgacaggucaaaagaacuauacuucaacaaacaaacgguuggucaauaccaaauggaaaugcucgauaaaaaccccaaugcaagucugagaaacauggucuucuacagacaagauuauuuggacgaguucaacaugcuuugggaaaaacaagcaguauaccauaaagaauuaaccgaggaacucaaaaaggaaaucagggauauuauaaucuuuuaccaaaggcgauuaaaaagccaaaaaggauuaauuggauucugcgaguucgaaagcagacaaauagaagucgauauagauggaaagaagaaaauuaaaaccguaggcaaucgcgucaucagccguucuuccccauuauuccaagaauuuaaaauauggcaaauacuuaacaacaucgaaguaacgguagucggaaagaaaagaaaaagacgaaaacuuaaagaaaauuacagcgccuuauucgaagaacuaaacgaugcggaacaacuugaauugaacggcagcaggcgauugugccaagaagaaaaagaacuccucgcacaggaacuuuucauaagagauaaaaugacaaaaagcgaaguacuaaaauuacucuuugacaacccacaagaacuugacuuaaacuucaaaacaauagacggaaauaagaccgguuacgcauuauuccaagcauauagcaaaaugauagaaaugucaggccacgaaccaguugauuuuaaaaagccuguggaaaagguaguugaauacauaaaggcaguauuugacuuauuaaacuggaacacagacauacuaggauucaauaguaacgaagaacucgacaaccaaccauauuacaaguuguggcaccuauuauacucauuugaaggcgacaacacaccaacaggaaacggccgacuaauccaaaagaugacagaguuauacggauuugaaaaagaauaugcaaccauucuagcuaacguaaguuuccaagaugacuacggaucguuguccgcaaaagcuauacauaaaauauuaccacacuuaaaagaagguaacagauaugacguagcauguguauaugcaggauaucgucacucagagucuagccucacccgagaagaaauagccaauaaaguacuuaaagaucgccuuaugcuacuccccaaaaacucauuacauaauccagucguggagaaaauauuaaaccaaaugguaaauguaauaaauguaauaauagauauauacggaaaaccagacgaaaucaggguagaauuagcaagagaacuaaagaaaaaugcaaaagaaagagaagaauuaacaaaaagcauagcacaaacaacuaaagcacacgaagaauauaaaacacugcuucagacagaguucggucuaacaaacguuagccgcacggacauauuacgguacaaauuauauaaagaacuagaaucuuguggguacaaaacucuauauaguaauacauacauaucacgugaaaagcuauucucaaaagaguucgauauugaacacaucaucccucaggcuaggcuauucgaugauagcuucagcaauaaaacauuagaagcaagaucaguuaacauagaaaaagggaauaagaccgcguacgacuuugugaaagaaaaguucggggaaagcggggcagauaauucacuagaacacuaccuuaauaacaucgaagauuuauuuaaaagcggcaaaauaucaaaaacaaaguauaacaaauuaaaaauggcagaacaagacauaccagauggguucauagaacgugacuugagaaauacgcaauauauugccaaaaaggcccuaucgauguuaaacgaaaucagucauagaguagucgcgacaagcggaucgguaacagacaaacucagagaagacuggcagcuaaucgacgucaugaaagaacuaaauugggaaaaguacaaagcauuaggccuaguagaauacuucgaagauagagacggucgucaaauuggucguauaaaggacuggacaaagcgaaacgaccauagacaucacgcaauggaugccuuaacgguagcuuuuacgaaggacguauucauucaauauuucaauaauaagaacgccagucuagacccuaacgcaaaugaacacgcuauuaaaaauaaauauuuucaaaauggaagggcaauagccccaaugccauuaagagaguucagagcggaagcuaagaaacauuuggaaaacacccuaauaucaaucaaagcuaaaaacaaaguaauuacaggaaauauaaacaaaacaaggaagaagggaggaguuaauaaaaauaugcaacaaacaccccguggccaauuacaucuugaaaccauauaugguucagggaagcaauaucuaaccaaagaagaaaaaguuaacgcaucauucgacaugagaaaaaucgggacgguaucaaaaucagcauaucgcgacgcacuauuaaaacgacuuuacgaaaacgauaaugauccaaagaaagcauucgcgggcaaaaauucgcuugauaaacaaccuaucugguuagauaaagaacaaaugagaaagguuccagaaaaagucaaaauagugacauuagaagccauauacacuauaaggaaagaaauaaguccagaucuaaaaguugacaaagugaucgauguaggaguacgaaaaauauuaauagacagguuaaacgaauauggaaaugaugccaagaaagcauucaguaaucuagauaaaaacccaauuuggcuaaacaaagaaaaaggaauaagcauaaaaagaguaacaauaucgggaauaucaaaugcgcaaagccuacauguuaagaaagauaaagauggaaaaccgauuuuagacgaaaaugguagaaacauaccuguagauuucguuaauacggggaauaaucaucacguugcuguauacuaccggccugugaucgacaaaagaggucagcuaguagucgacgaagcagggaauccgaaauacgaacuagaagaagugguaguaucguucuuugaggcaguaacaagagcuaacuuaggucuaccaauaauagacaaagacuauaaaacaacagaagguuggcaauuucuauuuucaaugaaacaaaaugaguauuuuguuuuccccaaugagaaaacaggcuucaaucccaaagaaauagauuuguuagacgucgaaaauuacggucuaauaucaccaaaccuauuuagaguucaaaaauucagccuuaaaaauuauguauucagacaccacuuagaaacaacaauaaaagauacaucuagcauacuaagagguaucacuuggaucgauuucaggagcagcaaagguuuagauacgauagucaagguaaggguuaaucauauaggacaaauuguaucaguaggagaauacuga

SEQ ID NO: 9160 - RNA, 4311 nt, Artificial Sequence
  Cas9 variant
augaaaagaauacuaggacuagacuuaggcaccaacucuaucgggugggcucucgucaaugaagccgaaaacaaagacgaacggaguaguaucguaaaacuaggaguacgagucaacccacuuacuguggaugaauuaacaaauuuugaaaagggaaaaucaauaacaacaaaugcagacagaacauuaaaaagagggaugaggaggaaccuacaaagauacaagcuaagaagagaaacccucacugaaguacuaaaagagcauaaauuaaucacagaagauacuauuuugagugagaacggaaaccgaaccacauuugagacauaucgacuacgagcaaaagcaguaacagaagaaaucagccuagaagaguucgcaagaguacuccuaaugauuaacaagaaaagaggauauaaaaguaguagaaaagcaaaaggaguagaagaagguacauuaauagacggaauggauauugcgagagaacuauacaacaacaaccuaacacccggugaacuuugucuucaacuauuggacgcaggaaagaaauuucucccagacuuuuacagaagcgaccuacaaaacgaauuagaucgcauaugggagaaacaaaaagaauacuacccggaaauacucacagauguuuugaaagaggaauuaagaggaaagaaaagagaugccgugugggcaauaugcgcaaaauacuucguauggaaagagaauuauacugaauggaacaaagaaaaaggaaaaacugagcaacaagaacgagagcacaaacuggaaggcaucuacagcaaacgaaaaagggaugaagcuaaaagggagaaucuacaauggaggguuaauggauugaaagaaaaacugagcuuagaacaacuuguaauaguauuccaagaaaugaacacacaaaucaauaacucgucuggauacuuaggagcaauaucggauagaaguaaagagcuguacuuuaauaaacaaacaguggggcaauaucaaauggaaaugcuugauaaaaauccuaaugcuucauuacggaauaugguauuuuauagacaagauuaccuagaugaguucaauaugcuaugggaaaaacaagcaguauaccacaaagaacuuacggaagaauuaaagaaagaaauuagagauauuauuauauucuaucagagacgucuaaaaagucagaaaggccugauaggcuucugcgaguuugaaagucgacaaauagaaguagacaucgaugguaaaaagaaaaucaaaaccguaggaaacagagucaucucucgcuccucaccauuauuccaagaguuuaaaauuuggcaaauacucaacaauauagaagugacaguuguuggcaagaaaagaaaacgccguaaauuaaaagaaaauuacucggcucuauucgaagaacuaaacgacgcagaacaauuagaacuaaacggaucccgaagacuaugccaagaagaaaaagaauuacuagcgcaagaacucuucauaagagacaaaaugacaaaauccgaaguacuaaaacuauuauucgauaacccccaagaacucgaccugaauuucaaaacuaucgacggaaacaaaacaggauacgcauuauuucaagcauauaguaaaaugauagaaaugucaggacaugaaccagucgauuuuaagaaaccaguagaaaaaguuguugaauauauaaaagccguauuugacuuauuaaauuggaauaccgacauccugggauuuaauucaaaugaggaguuagauaaccaaucauauuauaaauuguggcaccuauuauauagcuucgaaggugauaacacaccgacuggcaaugguagguuaauacagaaaaugacagaacuauacggauuugaaaaagaauacgcgacaauauuagcaaacguaaguuuucaagaugauuaugguucacuuagugcuaaagcaauucacaaaauauuaccacacuuaaaagaaggaaaucgauaugauguagccugcguauacgcaggguaucgacacagugaaagcucauuaacgcgcgaagaaauagcaaacaaaguuuugaaagauagacuaaugcucuuaccgaaaaacucuuuacauaauccaguuguagagaaaauacuuaaccaaaugguaaaugucauaaauguaaucaucgacauauacgguaaaccagacgaaauacgaguagaacuagccagagaacucaagaaaaacgcaaaagaaagagaagaauugaccaaaaguauagcacaaacgacuaaagcgcaugaagaauacaaaacgcuacugcaaacagaguucggucuuacaaacguaucacguacagauauacuaagauauaaacuauacaaagaacuugaaagcugcggauauaaaacucuauauucaaacacauacauaagccgagagaaacuuuucaguaaagaguucgauaucgaacauaucauaccacaagcacgacuauuugaugacuccuuuucgaacaaaacauuagaagcccgcucagucaauauagaaaaagggaacaagacugcauaugacuucguaaaggaaaaauucggugagucuggggccgauaauucacucgaacacuaccucaacaacauagaggaucucuucaaaucaggaaaaaucucgaagaccaaauauaacaaacucaaaauggcagagcaagacauuccagauggauucauagaaagggaccugaggaacacccaauacauagccaaaaaggcacuaagcaugcuuaaugaaauaagccaucgaguuguagcaacaaguggaucaguuacagacaagcuaagagaagauuggcagcuaauugacguaaugaaagaauugaacugggaaaaauacaaagcauuagguuuagucgaauauuuugaggauagagaugguagacaaauaggaagaaucaaagacuggacuaagcgaaacgaucacagacaucaugcuauggaugcauuaaccguagcauuuacaaaagacgucuucauucaauauuucaauaacaagaacgcaucacuagauccuaacgcaaaugaacacgcgauuaagaauaaauauuuccaaaacggacgugcaauagcuccaaugccguuaagagaauuuagagcagaagcaaagaaacaccucgagaacacguugauuagcauaaaagccaaaaacaaagucauaacagggaacauaaauaaaacuaggaagaaaggaggcguuaacaaaaacaugcagcaaacaccacgaggccaauugcaccuugaaaccauuuacggcucaggaaaacaguauuuaaccaaagaagaaaaaguaaaugcaaguuuugacaugaggaagauagguaccguaagcaagcuagcguaucgugaugcguuauuaaagcgauuauaugaaaaugacaacgauccaaagaaagccuuugcagguaaaaauucacuagacaaacaaccuauuuggcuggauaaagaacaaaugcgaaaaguaccagaaaaaguaaaaauuguaaccuuagaggcaauauacacaauaagaaaagaaaucucgccagaccuuaaagucgauaaaguaauagaugucggaguaaggaaaauacuaauugacaggcuaaaugaauauggaaacgaugcgaagaaagcauucucaaacuuagacgaaaauccaaucuggcuaaacaaagagaaaggaauaaguaucaaacgaguaacuaucagcggaauaucaaacgcgcaaucauuacaugucaagaaagacaaagacggaaaaccuauccuagacgaaaacggaaggaacauuccaguugauuuugucaauacaggcaacaaucaucacguagcagucuauuacagaccaguaauagauaaacgaggccagcuuguaguagacgaagcaggcaacccgaaauacgaauuagaagaaguaguagucaguuucuucgaagccguaacucgugcaaacuugggacaacccauaauagacaaagacuauaaaacaaccgaaggcuggcaauuucuauuuaguaugaaacagaaugaauacuuugucuuuccaaaugagaaaacaggauucaauccuaaagaaauagaucuauuagacguagaaaauuauggacugauuucaccuaacuuauuucgaguacagaaauuuucacucaaaaauuacguauuucgccaccaccuagaaacaacaauaaaagacacaucgagcauacuaagagggauaacguggauagauuuuagaagcuccaaagguuuagacacuaucguaaaaguucgugugaaucauauaggacaaauaguuucagugggugaauacuga

SEQ ID NO: 9161 - RNA, 4311 nt, Artificial Sequence
  Cas9 variant
augaagaggaucuuaggauuagaucuaggaacaaacagcauagguugggcauuaguuaaugaagccgaaaacaaagacgaacgaagcucaauaguaaaacugggaguacgcgucaauccauuaacaguugacgaauuaacuaauuuugagaaaggaaaaaguauuacuaccaacgcugauagaacauuaaaaagaggaaugcgacgaaaucuacaacgauauaaguuacgacgagaaacccucacagaaguacucaaagaacacaaauuaaucacagaagauacgauacuuucggaaaacggaaaccgaaccacauuugaaaccuaucgauuaagagcaaaggcggucacggaagaaaucuccuuagaagaguucgcaagaguacuacuuaugauaaauaaaaagagaggauacaaaaguucaagaaaagcuaaaggugucgaagagggaacucuaauagauggaauggacaucgcaagggaauuguauaacaauaacuuaacccccggugaauuaugucuacaguuacucgaugccggaaagaaauuucuaccugacuuuuacagaagugaccuacaaaaugaauuagaccggauaugggaaaaacaaaaagaauauuacccagaaauuuuaacagauguacuuaaagaagaauuaagagggaagaaacgugaugcagugugggccauaugugccaaauauuucguuuggaaagaaacauacacagaguggaauaaagagaaggguaaaacagagcagcaggaaagagaacacaagcucgaaggaauuuauucuaaaagaaaaagagacgaggccaaaagagaaaaccuacaauggagagucaacgggcuaaaggaaaaauuaucucucgaacaauuagucauagucuuccaagaaaugaauacacaaaucaauaacagcaguggguacuuaggcgcuauuagcgacagaagcaaagaauuauauuuuaauaagcaaacugugggccaauaucaaauggagauguuagacaaaaauccuaacgcaucgcuaagaaauaugguauucuauagacaagauuaccucgacgaguuuaauaugcuaugggaaaaacaagcaguauaucauaaagaauuaacagaagaacuaaagaaagaaauuagagacauuauaaucuucuaccaacgacgccuaaaaucucaaaaaggcuuaauaggauucugugaguucgaaucaaggcaaauagaaguagauaucgauggaaagaagaaaauaaaaacaguaggaaaccgaguaauaucuagaucaaguccucuauuucaagaauuuaaaauauggcaaauauuaaacaacauagaaguaacggugguagguaagaaacgaaaacguaggaaacuaaaagagaauuacagcgcuauuuuugaagaauuaaaugaugccgaacaacucgaauuaaauggaucaagacgacuaugucaagaagaaaaagaacucuuggcacaagaacuauuuguccgcgacaaaaugacaaaauccgaaguauuaaaacuccuauucgacaauccgcaagaacuagacuuaaauuuuaaaacaaucgauggaaacaaaacagguuaugcacucuuucaagcauacagcaaaaugauagaaaugucugggcaugaacccguagauuucaagaaacccgucgaaaaagugguagaauacauaaaagcuguauuugacuuauuaaauuggaacacggacaucuuggguuuuaacucaaaugaagaacuugauaaccaaucguacuacaaacucuggcauuuacucuauaguuuugaaggagauaauacucccacaggaaacggucgcuuaauacagaaaaugaccgaacuauacggcuucgaaaaagaauaugcuacaauauuagcaaauguuagcuuucaagacgacuacgggagucuaagugcuaaagcgauacacaaaauacuaccacaccuaaaagaaggaaacagauaugacguagcauguguuuacgcagguuaccgucacagugaaaguaguuuaaccagagaagaaauagcaaauaaagugcuaaaagaccgacucaugcuacuacccaaaaacucacuacacaaucccguaguugagaaaauccuaaaccaaaugguaaacguuaucaacgucaucauagauauauauggaaaaccggaugaaauacguguagaacuagcgagagaacuaaagaaaaaugcaaaagaacgagaagaacuaacaaaauccauagcacaaaccacgaaagcuaacgaagaauauaaaacauuauuacaaacagaauuugguuuaacaaacguaaguagaacagacauuuugagauauaaacuguauaaagaacucgaaucaugcggguacaaaacucucuauucgaauacauauauuucgcgagaaaaauuauucucuaaagaguucgacauagagcacauaaucccacaagcaagacucuuugaugacuccuuuucuaacaaaacauuagaagcaagaaguguaaacauugaaaaaggaaauaaaacagcauacgauuucguaaaagaaaaauucggagaaucaggggcagacaauucauuagaacacuauuuaaauaacauagaagaccuauucaaaaguggcaaaauaucuaaaacaaaauacaacaaauuaaaaauggcaaagcaagauauaccugacggauuuaucgagcgagaccucagaaacacacaauauauagcaaagaaagcauuaagcauguugaacgagaucagucauagggucguagcaacuagcgguaguguaacugacaaacuccgagaagacuggcaacugauugacguaaugaaagaacugaauugggaaaaauacaaggcuuuaggccuagucgaguacuuugaagacagagauggaagacaaaucggaagaauaaaagacuggacaaaaagaaacgaucacagacaccacgcuauggaugcauuaacaguggcauucaccaaagacguguuuauacaguacuuuaacaacaaaaaugccagucuugaucccaacgcuaaugaacacgcaauuaaaaacaaguauuuucaaaaugguagagcuauagcacccaugccucucagagaguucagggcggaagcaaagaaacacuuagaaaacacauuaauaucaauaaaagccaaaaauaaagugauaacaggcaauauuaauaaaaccagaaagaaagguggugucaauaaaaauaugcaacaaacaccuagaggacaacuacacuuagaaacaaucuacggaaguggcaaacaauaccugacgaaagaggaacggguuaacgcaucuuuugacaugagaaaaauagaaaccguuagcaaaagugcuuaccgggaugcguuauuaaaacgacuauaugaaaaugacaaugauccgaagaaagccuuugcagguaaaaacucauuagauaaacaaccaauauggcucgauaaagaacaaaaacgaaaaguaccagaaaaagugaagauagucacauuagaagcuaucuacacaauacgcaaagaaauaucaccagaucucaaaguagacaaagucauagacguaggaguaagaaaaauauuaauagauagacuuaaugaguacggcaaugacgcuaagaaagcauuuucuaaucucgacgaaaacccaauuuggcuaaacaaagaaaaagggauuucaauaaaaagaguaacuauauccgguauaucaaaugcacaaucguuacacgugaagaaagauaaagauggcaaaccuauccuagacgaaaauggccgaaacauaccaguagacuucguaaauacagggaacaaucaucacgucgcuguauauuacagaccggugauagauaaaaggggacaauuagucguagaugaagccggaaacccgaaauacgagcuugaagaaguaguaguaucauuuuucgaagcaguaacuagggcaaacuuagggcaaccgauuaucgauaaagacuacaaaaccaccgaagguuggcaauuccuauuuaguaugaaacaaaacgaauauuuuguauuuccaaaugagaaaacuggauucaacccaaaagaaaucgaccucuuagauguagaaaauuacggauugauaucuccaaaucuauuuagaguacaaaaguucucacuuaaaaauuauguuuuccggcaccaucuagaaacaacaaucaaagauaccucaucaauacugagaggaaucacuuggauagauuuucguucaagcaaaggauuagacacaauaguuaaaguucgaguuaaucacaucgggcaaauaguaaguguaggagaauacuga

SEQ ID NO: 9162 - RNA, 4311 nt, Artificial Sequence
  Cas9 variant
augaaaaggauacuuggauuagaccuuggaacuaauucaaucgguugggcccugguaaaugaagcagaaaacaaagacgagcggaguaguaucgugaaacugggggucagagugaacccccuuaccgucgacgaauugacaaacuuugaaaaaggaaaaaguaucacaacaaaugcugacagaacacugaaaagaggaaugagaagaaaccuacaacgauacaaauuaagaagagaaacauuaaccgaaguacuaaaagaacacaaacuaaucacagaagauacuauucuaucagaaaacggaaauagaacuacuuuugaaacauaccgacuacgggcaaaagcaguaacagaagaaauaagucuggaagaauuugcaagaguccuacuaaugaucaauaagaaaagaggguauaaaucuagcagaaaagcaaaaggcguggaagaaggcacccuuauagacggcauggacauagcaagagagcuauauaacaauaauuugacaccuggggaacuaugucuccaacuauuagaugcugggaagaaauuucuaccagacuucuaccgcucagaccuccaaaaugaacucgauagaauaugggaaaaacaaaaagaauauuacccagaaauacuaaccgauguacuuaaagaagaauuacgagguaagaaacgagaugcagucugggcaauuugugcaaaauauuucguuuggaaagagacauauacggaauggaauaaagaaaaaggaaaaacagaacaacaagaaaaagaacacaaacuagaaggcauuuauagcaaaagaaaacgcgaugaagcgaaaagagaaaaucuucaauggagaguaaacggacuaaaagaaaaauuaucacuugaacagcuaguaauaguauuccaagagaugaacacacaaauaaacaauucaucaggauaccuaggagcaauuagcgauaggagcaaagaauuauauuucaacaaacaaaccguaggacaauaccaaauggaaauguuagauaaaaauccaaacgcaucgcuuagaaacaugguauucuauagacaagauuaucucgacgaguuuaacaugcuaugggagaaacaagcaguuuaucacaaagaacuaacagaggaacuaaagaaagaaauaagagacauaaucaucuucuaccaacgcaggcucaaaucgcaaaaaggucuaauugguuuuugcgaauuugagucucgacaaauagaaguugauauagaugguaaaaagaaaaucaaaacagucggaaacagaguaauaucaagaagcucaccucuuuuucaagaauuuaaaaucuggcaaauacuuaauaauauugaaguuacaguagucggaaagaaacgaaaaaggagaaaauuaaaagaaaauuauucagcuuuauucgaagaguuaaaugacgcggagcaauuagaacugaacggaucucgaagacuuugccaagaagaaaaagaacucuuagcacaagaauuauuuauacgagacaaaaugaccaaaagcgaaguucucaaacuucuguucgacaauccccaagaacucgaucuuaacuuuaaaacaauagaugggaacaaaacagguuacgcacuguuccaggcuuacucaaaaaugaucgaaaugucaggacaugaaccaguugacuuuaagaaaccugucgaaaaaguaguagaguacauaaaagcaguuuuugaccuacugaacuggaacaccgacauacuaggauucaacaguaacgaggaacuagauaaucaaucguacuacaaacuauggcaccuauuauacuccuuugaaggcgacaauacgccaacuggaaauggaagacugauccagaaaaugacugaacuauacggauuugaaaaagaauacgcuacgauucuagcaaacguaucauuccaagaugacuauggaagucuaagugcuaaagcuauccacaaaauacugccgcaucuaaaagaaggaaauagauaugauguagcguguguauacgcuggauaccgacauagcgaauccucucucacaagagaagagauugccaacaaaguacuaaaagaccgacuaaugcuccuacccaaaaacaguuugcauaauccagucguugagaaaauuuuaaaccaaaugguaaacguaaucaacgucaucauagacaucuaugggaaaccagacgaaauaagaguagaauuagcaagggaacuuaagaaaaaugcaaaagaaagagaagaauuaacuaaaucaauagcgcaaacaacuaaagcgcacgaagaauauaaaacgcuacuacaaacagaguucggacuaacaaacguuucgcguacagauauacuccgauauaaacuuuacaaagaacucgaaaguugcggauacaaaacacuauacaguaauacauauauaaguagagaaaagcuauuuucaaaagaauuugauauagaacauauaaucccccaagcucgacuauucgaugauaguuucaguaacaagacucuagaagccaggucaguuaacauugaaaaaggcaauaagacagcauacgacuucguaaaagaaaaauuuggagagucgggugcugauaacagucuagaacacuauuuaaacaacaucgaagaucuauucaaaucaggaaagaucagcaaaacuaaauacaacaaguuaaaaauggccgaacaggacauaccugauggauucauagagagagaccuucgaaacacacaguauauugcaaagaaagcacugucuauguuaaacgaaauaucccauagaguaguggcaacgaguggaucaguaaccgauaaacuacgagaagacuggcaguugauagacguaaugaaagaacuuaauugggaaaaauacaaagcacucggccucguugaguauuucgaagauagagacgggcgucaaauaggucguauaaaagacuggacaaaaagaaacgaccacagacaucacgccauggaugcauuaacggucgcuuucacuaaagauguauuuauucaauacuucaacaauaaaaacgcaucauuagaccccaacgcaaacgaacacgcaaucaaaaacaaauauuuccaaaaugguagagcaauagcgccgaugccauuaagagaguuccgggcagaagcgaagaaacaucuugaaaauacgcucaucucgauuaaagccaaaaauaaaguuauuacaggaaacauuaacaaaaccagaaagaaaggaggaguaaacaaaaauaugcaacaaacaccgagaggacaauugcauuuagaaaccauuuaugguuccggaaaacaauaccucacaaaagaagaaaaagucaaugcuaguuuugacaugagaaaaauaggcacaguaucuaaacucgcauaccgagaugcauuacucaaaagauuauaugaaaacgauaaugacccuaaaaaggcuuuugcugguaaaaauucccucgacaaacaaccaauaugguuagacaaagaacagaugagaaaagugccagaaaaaguuaaaauaguuacccuugaagcaauauacaccauucggaaagagauaagcccagacuuaaaaguugacaaagugaucgaugugggaguuagaaaaauauuaauugacagacuaaacgaauaugggaaugaugcaaagaaagcauucucaaacuuagaugaaaacccuauauggcuuaacaaagaaaaaggaaucucuauuaaaagaguaacaaucucaggaauaucaaacgcucaaucgcugcacguuaagaaagauaaagauggaaaaccaauacuugacgagaacggacggaacauuccgguugauuuuguaaauacgggaaacaaccaucauguagccguauacuacagaccagugauagauaaacggggacaauuaguaguagacgaagcagguaaccccaaauaugaacuagaagaaguaguaguaucauucuucgaagcuguaacacgagcuaaucuaggucaaccgaucauagauaaagacuauaaaacaacggaaggauggcaauuucuauucucuaugaaacaaaaugaauacuucguauucccuaaugagaaaaccggauuuaacccaaaagaaauagaucuacuugaugucgaaaauuacggauuaaucagcccgaaccuauucagaguccaaaaauucagucuuaaaaauuacguuuuuaggcaccacuuagaaacuaccauaaaagacacaucaucuauauuaagggguauaaccuggauagacuuccgaagcagcaaaggacuggacacaauuguuaaaguaagagugaaucacauaggucaaauuguaaguguaggggaguauuga

SEQ ID NO: 9163 - RNA, 4311 nt, Artificial Sequence
  Cas9 variant
augaaaaggauucugggacuggaucugggaaccaauuccauuggcugggcacugguaaaugaagcagaaaauaaggacgaaagauccucaaucguaaaacucgguguaagaguaaauccacuaacaguagacgaacuaacuaauuuugaaaaggguaaaagcauaacaacaaaugccgauagaacgcugaaaagggguaugagacgaaauuuacaacgauacaagcuaaggagagaaacucucacagaaguuuuaaaagaacauaaacucauaacagaagacaccauuuuaagugaaaacgguaaucguacaacauuugaaacguaccgauuaagagcuaaagcgguaacagaagaaauuucgcuagaagaauuugccagaguacugcuaaugauaaauaagaaacgagguuauaaauccagccggaaagcaaaagguguggaagaaggaacacuaauagacgggauggauauugcccgagaacuauauaacaacaaccuaacaccuggagaauuaugucuacagcucuuagacgcgggaaagaaauuccuucccgauuucuaucgaucagaucuucaaaacgagcuagauagaauaugggaaaaacaaaaagaauacuacccagaaauacuuacagacguccugaaagaagaauugcgagguaagaaacgagacgcaguaugggcuauaugcgcuaaauacuucguauggaaagaaaauuacacagaauggaauaaagaaaaaggaaaaacagaacagcaggaaagagaacacaaacuagaggguauuuacaguaaacgcaaaagagaugaagcaaaaagagaaaacuuacaguggcgcgucaacggacuuaaagaaaagcuaucacuagaacagcuuguaauaguauuucaggaaaugaauacacaaauaaauaacuccaguggguauuuaggcgcgaucucggacagaucaaaagaauuauauuucaacaaacagacaguaggacaauaucaaauggaaauguuagauaaaaacccuaaugcgaguuuaagaaauaugguauuuuaccgacaagacuaccuagacgaguucaacaugcuuugggaaaaacaagccguuuaucauaaggaacuuacagaagaacuaaagaaagaaauacgagauauuauuauuuucuaucaacgaagacuaaaaagucaaaaaggccuaauagguuuuugugaguucgaaaguagacaaaucgaagucgauauagaugguaaaaagaaaauaaaaacuguuggaaaucgugucauaaguagaaguagucccuuauuccaagaguucaaaauauggcaaauuuuaaauaauauagaagugacaguuguaggaaagaaaagaaaaaggagaaaacuuaaagaaaauuauagcgcccuauuugaagaacucaacgacgccgaacagcuggaacuaaauggcucgagacgacugugccaagaagaaaaagaacuacuggcgcaagaacuauucauaagggacaaaaugacaaaaagcgagguccuaaaacuacuauucgauaauccacaggaauuagaccucaauuucaaaacgauagacggcaauaaaacaggauacgcuuuauuccaagcauauaguaaaaugauagaaaugagcggccacgaaccgguagacuucaagaaaccuguagaaaaaguugucgaauacauaaaagcaguauucgaccuacuaaauuggaauacagacauacuaggauucaacucaaacgaagaacuagacaaccaacccuacuauaaacuuuggcaucuuuuauacucauucgagggagauaacacaccgacaggcaauggcagauuaauacagaaaaugacggaacuauacgguuucgaaaaagaauaugcaacaauauuagcaaauguuaguuuccaagacgauuaugggucauuaucagccaaagcaauacacaaaaucuuaccacacuuaaaagaaggaaaucgauacgauguagcuugcguuuaugcaggauauagacacagugaaagcagccuaacaagagaagaaaucgcaaauaaaguuuuaaaagacagauuaaugcuacuaccgaaaaacucucuucauaauccaguuguugagaaaauacugaaccaaaugguaaacgucauaaacgugauaauagacauuuacggcaaaccagaugaaauucgagucgaauuagcuagagaauugaagaaaaacgcaaaagaacgugaagaauuaacuaaaucaauagcucagacaacaaaagcacaugaagaauacaaaacucuguuacaaacagaauuuggucucacaaacguaucaaggacugacauacuaagguauaaauuauacaaagaacuagaaucuugcggauauaaaacacuuuauaguaacacauauauuucacgcgaaaaauuauucucgaaagaauuugauaucgaacacauaauaccucaagcaagacuuuucgaugacaguuuuuccaauaaaacauuggaggcuagaucaguuaacauagaaaaagggaacaaaacggcauacgacuucguuaaagaaaaauuuggggaaagcggugcagauaacaguuuagaacauuaucuaaauaacauagaagaccucuucaaauccggaaaaauuucuaaaacgaaauacaacaaauugaaaauggcagaacaagacauaccagauggauucauagaaagagauuuacgaaauacucaauacauugccaagaaagcacuuaguaugcuuaaugagauaucucacagaguaguagcuacaaguggaucaguuacugauaaacuccgagaagauuggcaacuaauagauguuaugaaagaacucaacugggaaaaauacaaagcacucggauuaguugaguacuuugaagacagggacgggcgacagauaggaaggauaaaagacuggacaaaacggaaugaccauagacaucacgcaauggacgcauugacgguagcuuuuaccaaagacguauuuauacaauauuucaauaacaaaaacgcgucucuggacccaaacgcuaacgaacaugcaauuaaaaauaaauacuuccaaaauggucgagcuauagcaccuaugccauuaagagaauuuagagcagaagcgaaaaagcaccuagaaaacacucuaauaaguauaaaagcuaaaaacaaagucauaacaggaaacauaaauaaaacaagaaagaaaggcgggguuaauaagaauaugcaacagacaccccguggucaacuucauuuagaaacuauauacggcaguggaaaacaguauuuaacuaaagaagaaaaaguaaaugcgucauuugacaugcgaaagauagguaccgugaguaaaagcgccuacagagaugcacugcugaagagacuauacgaaaacgauaacgacccgaaaaaggcuuuugcugguaaaaauagucuagauaaacaacccauauggcuagauaaagaacaaaugagaaaagugcccgaaaaagucaaaauaguaacccuggaagcaaucuacacaauaagaaaagaaauaucgagugaccuaaaaguagacaaaguaauagacgugggaguaagaaaaauucuuauagaccgauugaaugaauauggaaaugacgcaaagaaagcauuuucaaaucuagauaaaaauccaauaugguuaaacaaagaaaaaggaauuaguauaaaacgagugaccauaucaggaauaucuaacgcucaaucccuccacguaaagaaagauaaagauggaaaaccaauacuggaugaaaacggucguaauaucccaguagauuuugugaacacugguaauaaucaccauguggccguauauuauagaccaguuaucgacaaacgaggacaacuuguagucgaugaagcuggcaauccaaaauaugaguuggaggaaguaguagucagcuucuuugaagcgguaaccagagcaaaucuuggacugccaauaauagauaaagauuauaaaacaacugaaggauggcaauuuuuauuuagcaugaaacaaaacgaauacuuuguuuucccuaaugagaaaaccgguuuuaauccaaaagaaauagaucuauuggauguggaaaacuacggauuaauaagcccaaauuuauuuagaguucaaaaauuuucacuuaaaaauuauguauucagacaccaccucgaaaccacaaucaaagacacaaguucaauacuaaggggcauaacauggaucgacuuuagaucgucaaaaggucuagauacaauagucaaggugagaguaaaccacauaggacaaaucguaagcgucggagaauauuga

SEQ ID NO: 9164 - RNA, 4311 nt, Artificial Sequence
  Cas9 variant
augaaacgaauauuaggcuuagacuuggguacgaacuccauagguugggcauuaguuaaugaggcagagaacaaggacgagcgaucaucuaucguuaaacucgguguaaggguaaacccccuaacuguagacgaguuaacgaacuuugaaaaaggaaagagcauuacaacaaaugccgauagaacacuaaaaaggggaaugcgacggaacuuacaaagauacaaauuacgccgcgagacauuaacagagguacuaaaagaacacaaacugauuacggaagauacgauccuuucagaaaaugguaacagaacuacauucgagaccuauagacugagagcaaaagcaguuacugaggaaauaucguuggaagaauuugcccgcguuuuauugaugauaaacaagaaacgaggcuauaaaucuagucguaaagcaaaaggcguagaagaagggaccuuaauagacggaauggauauagcaagagaacuauacaacaauaaccuaacgccaggagaauuaugcuuacaacuacuagacgccggcaagaaauuucuccccgacuuuuauagaucagauuugcaaaacgaauuagauagaauaugggaaaaacaaaaagaauacuacccugagauacugacagacguccuaaaagaagaauugagaggaaagaaaagagacgccguaugggcaaucugugcaaaauacuuuguauggaaagaaaauuauacagaguggaauaaagaaaaaggaaaaacagaacaacaagaacgagaacacaaauuagaaggaauauauaguaaaagaaaacgcgacgaagcaaaaagagaaaaccuacaauggagagugaacggucucaaagaaaaacuaagucuagaacaauuaguaauaguguuucaagaaaugaauacgcaaauaaacaauucuaguggguauuugggagcaauaagugacagaucuaaagaguuauauuucaauaaacaaacugucggacaaugccaaauggaaauguuagacaagaauccaaaugcgaguuuacggaauaugguauucuacagacaagauuacuuagacgaguucaauaugcuaugggaaaaacaagccguuuaucauaaagaacuaaccgaagaauuaaagaaagaaauuagagacauaauaauauucuaccagagaagauuaaaaagucaaaagggauuaauagguuuuugcgaauuugaaucuagacaaauugaaguugauauagacggaaagaagaaaauaaaaacaguaggaaauagggucaucucaagaaguaguccauuauuucaagaguucaaaauauggcaaauuuuaaauaacauagaaguuacagucguuggcaagaaaaggaaaagaagaaaauuaaaagaaaauuacagcgcacuuuuugaagaauuaaaugaugcagaacaacuagaacuaaacggcucuagacgauuaugucaagaagaaaaagaauuauuagcacaagaguuauucauaagggauaaaaugacaaaaagcgaaguccuaaaacuacuuuuugauaacccacaagagcuugaucugaauuuuaaaacaaucgauggaaacaaaacuggauacgcauuauuccaagcauauucaaaaaugauagaaaugucaggacaugaaccugucgacuuuaagaaaccaguggagaaagugguagaauauauaaaagcuguauuugaccugcuaaacuggaauaccgauauacuaggauucaacaguaacgaagaacuugacaaucaacccuauuauaaacucuggcaucuacuuuauucuuucgaaggcgacaacacuccaacaggaaauggucgauuaauccagaaaaugacagaacuauacggauucgagaaagaauaugcuaccauacucgccaacgucaguuuccaagacgauuacggaucgcugagugcaaaagcaauacauaaaauacuaccccaccuaaaagagggaaacagguacgauguggcaugcgucuaugcgggcuauagacauucggaaagcucauuaacgagagaagagauagccaacaaaguccucaaagauagacuuaugcuccugcccaaaaauucacuacacaacccaguaguggagaaaauauuaaaucaaaugguaaacguaauaaacgucauaaucgauauauacggaaaacccgaugaaaucagaguagaacucgcaagggaauuaaagaaaaaugccaaagaaagggaagaacuaacuaaaagcauugcacaaacaacaaaagcacacgaggaauacaaaaccuuacuacaaacagaguucggacuuacuaauguaucaagaacagauauacugcguuauaaacuauacaaagaacuagaaagcugcggauauaaaaccuuauauucuaauacuuauauuucaagggaaaaauuauuuaguaaagaguucgacauagaacacauaauaccgcaagcaagacuauucgaugacucuuucucaaauaaaacacuggaagcaaggucuguaaauauagaaaagggaaacaaaacggccuaugauuucgugaaagagaaguuuggagagaguggugcggauaauucccuagaacacuaccuuaacaacauagaggaucuauuuaagucaggaaaaauuucaaagacaaaauauaauaaacuaaaaauggcagaacaagauauaccugauggauuuauugaaagagaccuaaggaauacacaauauauagccaaaaaggcauuaaguaugcuaaaugagauaucacaccgcguaguugccacgucaggguccguaacagauaaacuaagagaagauuggcagcuuauagauguaaugaaagaauuaaauugggagaaguacaaggcacugggcuuaguagaauauuucgaagaccgcgacggccgacagauuggccgaauaaaagacuggacaaaaagaaacgaucacagacaccacgcuauggaugcacuaacaguagccuuuacaaaagauguguucauacaauauuucaauaauaaaaacgcuucauuagacccuaacgcaaacgaacacgcaaucaaaaacaaauacuuccagaauggaagggcgauagcaccaaugccacuaagagaguucagagcagaagcaaagaaacacuuggaaaauaccuuaauaaguauaaaagcuaaaaauaaggucauaacaggaaauauaaacaaaacacgaaagaaaggcggaguaaauaaaaauaugcaacaaacucccagaggacaauuacaucuugaaacuauauacggaagugguaaacaauauuugaccaaagaagaaaaaguaaacgcaucauucgauaugagaaaaauaggaacaguaucaaaaucugcauauagagacgcacuccuaaaaagacucuacgaaaaugacaaugaccccaagaaagcauuugccgguaaaaauucauuagauaaacaaccaauuuggcuugacaaagaacaaaugcgaaagguaccagaaaaaguaaagauaguaacucuagaagcaauauauacuaucagaaaagaaauaucacccgaucuuaaaguagauaagguaauugacguaggaguaagaaaaauacugauagacagauuaaacgaauacggaaacgacgcaaagaaagcauuuuccaaucucgacaaaaacccuauuugguugaacaaagaaaaaggcauaucuauaaagcguguuacaauaaguggcauaucaaaugcacaaagccugcacguaaagaaagauaaagacgguaaaccaauauuagacgaaaacgguagaaauauaccaguagacuucguuaauaccgggaacaaucaccacguagcuguguauuaccggccaguuauugauaaaagaggacagcuaguagucgaugaagccggaaauccaaaauaugaacuagaagaaguagucguuagcuuuuucgaagcuguaacaagagcgaaccuaggauuaccaauaauagacaaagacuacaaaacuaccgaagguuggcaauuccuauuuucuaugaaacaaaaugaauauuuuguauucccaaacgagaaaacaggcuucaacccuaaagaaaucgauuuauuagauguagaaaauuauggcuuaaucucucccaaucuauuuaggguucaaaaauuuucucuaaagaauuacgucuuucggcaucauuuagaaacaaccauaaaagacacgucuucuauauuaagaggaauaaccuggauagacuucagaucgucgaaaggcuuagauacgauuguaaaaguaagaguaaaucauauuggacaaauagucuccguaggagaauauuga

SEQ ID NO: 9165 - RNA, 4311 nt, Artificial Sequence
  Cas9 variant
augaaaagaauuuugggacuggaccucggaacaaacucuauaggaugggcgcuagugaaugaagcagaaaauaaggacgaaaggagcucaauuguaaaacugggugugagggugaauccucuaacuguagacgaauuaacaaauuucgaaaaagguaagucaaucacuacaaaugcagauagaacacugaaaagaggaaugagacgaaaccuacagagauacaaauugaggagagaaacacugaccgaaguacucaaggaacacaaacuaauuacugaagacacaauuuugagugaaaacggaaauagaacgacauucgaaacuuauaggcuuagggcgaaggcgguaacagaagaaauuucucucgaggaauuugcaaggguacucuuaaugauaaauaagaaacgaggguacaaaucuucccguaaagcuaagggaguugaggagggaacacucauugacgguauggacauagcccgugaacuauauaauaauaacuuaacaccgggagaauuaugucuacaauuauuagacgcaggcaagaaauucuuaccagacuucuauagauccgaccuacaaaacgaauuagauagaauuugggaaaaacaaaaggaauacuacccugaaauauuaacggacguguuaaaagaagaacuaagaggaaagaaaagagacgcgguuugggcaauaugcgcuaaauauuuuguauggaaagaaacauacacggaauggaauaaagagaaaggaaaaaccgaacaacaagaaagagaacacaaacuagaaggaauauauucaaaacggaaaagagaugaagcuaaaagggaaaauuugcaauggagaguaaacggccucaaagaaaaacuuagucuggagcaauuaguaauuguauuccaagaaaugaauacgcaaauaaauaacaguucgggauauuuaggagccauaucagauagaaguaaagaacuguacuucaauaaacaaacugucggccaguaucagauggagauguuagauaaaaacccaaaugcaucacuacgaaauaugguauuuuauagacaggacuaucuggaugaguucaauaugcuaugggaaaaacaagcuguauaccacaaagaacuaacagaggaacucaaaaaggaaaucagagacauuauaauauucuaucaaagacgauuaaaaagucaaaaaggccuaauaggcuucugcgaauuugaaagcagacaaauagaaguagacauagaugguaaaaagaaaauaaaaacagugggaaauagaguaaucuccagaagcaguccccuauuucaagaguucaaaaucuggcaaauuuugaacaacauagaaguaacaguagucggaaagaaaagaaaacgaagaaaacuaaaagaaaacuacagcgcaauauuugaagaauuaaacgaugccgaacaacuugaacucaauggaagcagaagacucugccaagaagaaaaagaauuacuagcgcaagaacucuucguaagagacaaaaugaccaaaucagaaguccuuaaacuauuauucgacaauccucaagaauuagaucuaaauuuuaaaacgauagacggaaacaaaacaggauaugccuuauuucaagcauacagcaaaaugauagaaaugucaggacaugaacccguagacuuuaaaaagccaguagaaaaagucguugaauauaucaaagcgguguucgacuuacugaauuggaacacagacauacuaggauucaauaguaaugaagaacuagauaaucagucuuauuacaagcuguggcaccuacuguacucauucgaaggagacaacacaccaacgggaaauggccgauuaauucaaaagaugacagaacuauaugguuucgagaaagaguacgcuacaauacuagcaaacgucaguuuucaagacgauuacggcucucuaucagccaaagccauacacaaaauucugccgcaucuaaaagaagggaauagauacgacguugcguguguauacgcaggauauagacacagugaaaguagcuuaaccagggaagaaauagcaaauaaaguucuuaaagaccgccuaaugcuuuuaccgaaaaauucacuacauaauccagucgucgagaaaauccuaaaucaaauggucaacguuauaaauguaauaaucgauaucuauggaaagccagaugaaauuagaguagaacuugcacgagaacucaagaaaaacgcaaaagaacgcgaagaauuaacaaaaaguauagcacaaacuacaaaagcuaaugaagaguauaaaacuuuauuacaaacagaguucggucuaacuaacguaucgagaacagacauuuugagguacaaacuauacaaagaacuagaauccuguggauacaaaacacuauacucgaacaccuauauaucaagggaaaaauuauuuucaaaagaguucgauauugaacauauuauaccacaagcgagacuauuugaugauucauuuucaaauaaaacccucgaagcccgaaguguaaauauagaaaaaggcaacaaaacagccuacgacuuuguuaaagaaaaauucggagaaucaggagcagauaauucacuagaacauuaucuaaacaacauagaagaucucuucaaaagcggaaaaauaucaaaaaccaaguauaacaaacuaaagauggcggaacaagacauaccagacggguuuauagaaagggaucuaaggaacacacaauauauugccaagaaagcauugucaauguuaaaugaaauaagccauagaguugucgcaacaucuggaucgguaacagauaaauugcgagaagacuggcaauugaucgacguuaugaaagagcuaaauugggaaaaauauaaggcacuaggccuaguagaauacuuugaagacagagacggacgacaaauaggacguauaaaagacuggacuaaacgaaaugaucacagacaucaugcgauggacgcacucacaguugccuucacaaaagacguauucauccaguacuucaacaacaaaaacgcauccuuagauccaaaugcaaaugaacacgcuaucaaaaacaaauacuuucagaaugguagagcaauagcaccuaugccacuaagagaguucagggcagaagcuaaaaagcaccuagaaaauacccuaaucucaaucaaagcaaagaacaaaguaauaacagguaacauuaauaagacacguaagaaaggagguguaaauaaaaauaugcaacaaacaccacgcgggcaguuacaucuagagacaauauacggcucugguaaacaauauuuaacaaaagaagaaaaagucaaugcuagcuucgacaugaggaaaauugaaacggucagcaaaucagcuuacagagacgcucuauuaaaaagacuauacgaaaaugacaaugauccaaagaaagcauucgccgguaaaaacaguuuagauaaacaaccuauauggcuagacaaagaacagaugagaaaaguuccugaaaaagucaaaauagucacgcuagaagcaauauacacaauuagaaaagaaauaagcccggacuuaaaaguugauaaagugauagacguaggaguaagaaagauauuaauagacagauuaaaugaauacggaaacgaugccaaaaaggcauucagcaacuuagacaaaaauccaauaugguuaaauaaggaaaaagggauaagcauuaaaagagucacgauaagcgguauaucaaaugcacagagcuuacaugucaagaaagacaaagacggaaagcccauucuagaugaaaacggacgaaauauaccagucgauuuugucaacacaggaaacaaucaccauguagcagucuauuacaggccaguaauagacaaacguggacaauuagucguagaugaagccggaaauccuaaauaugaauuagaagaaguuguaguuagcuucuuugaagcagucacacgagccaaucuaggacuaccaauaauugacaaagacuacaagaccacagaaggauggcaauuucuguuuagcaugaaacaaaacgaauauuucguauucccuaacgagaaaauuggauucaauccaaaagaaauagauuuguuagacguagaaaauuacggguuaauaucaccaaacuuauucagaguacaaaaauuuucauuaaagaacuauguuuuuagacaucaucuggaaacuacgauaaaagacacgaguagcauauuaagaggaauaacuuggauagauuucaggucgaguaaaggacuagacacaauaguuaaagucagaguaaaucacauuggacaaauaguaagcguuggcgaauauuga

SEQ ID NO: 9166 - RNA, 4311 nt, Artificial Sequence
  Cas9 variant
augaaaagaaucuugggauuagauuuaggcacuaacagcaucggaugggcccucgucgaugaagcagaaaacaaagaugaaagaaguaguaucguaaaacuaggggucagggucaacccacucacaguugaugaauuaaccaacuuugaaaagggaaaaagcauaacaaccaaugccgauagaacacuuaaaagagguaugcggagaaacuuacaaagguauaaacuacguagagaaacacucauggaaguauuaaaagaacacaaacuuauaaccgaggauacaauauuaagugaaaacggaaacagaacaacguuugaaacuuaucggcuaagagcaaaagcagcaacagagaagauaagucuagaagaauuugccaggguacuacuuaugaucaauaaaaagagaggauacaaaucaugccgaaaagcaaagggugcagaagaagggacccuaauagauggaauggauauagcaagagaacuguauaacaauaacuuaacgcccggagaauuaugucuacaacuacuggacgccgggaagaaauaccuaccagauuucuacagaagugacuuacaaaacgaacuggacagaauaugggaaaaacaaaaagaauacuacccugaaauacuuacugagguacucaaggaagaacuaaggggcaagaaacgagaugcagugugggcaauaugcgcaaaaaguuuuguaugggaagaauauuacacugaauggaacaaagaaaaagggaaaacugaacaacaagaaagagagcacaaacuugaaggaauauacucaaagagaaaaagagacgaagcuaaaagagaaaaucuucaauggcgaguuaacggcuuaaaagaaaaacuaucacuagaacaacuuguaauaguguuacaagaaaugaauauacaaaucaauaacagcagcggauaccuuggcgcuauaagcgacagaagcaaagaauuauacuucaauaaacaaacaguaggucaauaucaaauggaaaugcuugacaaaaacccaaaugcaucccugagaaauaugguauucuacaggcaagacuaccuagacgaauuuaauaccuuaugggagaagcaagccgaguaccauaaagaauuaacaggggaacuaaagaaagaaauaagggauauaguaaucuucuaccaaagaagauuaaaaagccaaaaaggauuaguagguuuuugcgaguucgaaagucgccaaaucgaaguagaaauagauggcaaaaagaaaauuaaaacugucggcaaccgagucauaccacgcucaucuccucuauuucaagaguucaaaauauggcaaauauuaaauaacauagaagucacaguaguagguaagaaaggaaaacgaagaaaacaaaaagauaacucaccaacuuuguucgauggcuuagaugacacagaacaguuagaacucaacggaagccgauaucucuaucaagaagagaaagaauuacuagcacaagaguuauucguccgcgacaaaaugaccaaaucagauguguuaaaauugcuauucgacaacccucaagaacuagaucuaaauuuuaaaacaaucgauggaaacaagacuggauacacauuguuucaagccuacucuaaaaugauagaaaugucagggcaugaaccaguagauuuuaagaaaacaguagagaaaguagucgaacaugugaaagcaguuuuugaucuacuaaacuggaacacggauauauuagguuuuaauucgaacgaagaacuagauaaucaaucuuacuauaagcuauggcacuugcuuuauucauucgaaggcgacaauacaccuacaggaaaugcacgauugguacagaaaauaacagaacuauauggcuucgaaaaggaauaugccauuauucucgcgaacgugaccuuucaagacgacuacggaucgcuaucugcuaaagcuauccacaaaauucucccacacuuaaaagaaggcaacagauacgacguagccugugcauacgcggguuauaaacacucagaaucaucauuaacaaaagaagaaauagcaaacaaagcauuaaaggauagguuaacauuacuccccaaaaauaaccuaagaaacccaguaguggagaaaaucuuaaaccaaaugguaaacgugauaaacgcaaucauagauacauauggaaaaccagacgaaauaagaguagaacuugcgagagaacuuaagaaaaacgcuaaagaacgcgaagaacuaacaaaauucauagcggaaacaacgagaaaacaugaagaguuuaaaauauuauuacaaagugaauuuggucuuacaaacguaaguagaaccgauauacuacguuacaaauuauacaaagaauuagaaucguguggauauaaaacccuauauucaaauacauauaucccacgagaaaagcuauuuaguaaagaauuugacauugaacauauuauaccucaagcaagauuauuugaugacuccuucagcaacaaaacucuagaagcaagaucaauaaauuuggaaaaaggaaauaaaacugcauaugacuucguaaaagaaaaauucggagaaucaggagcagauaacucgcuagaucacuauuuaaacaacauugaagaucuauuuaaaagugguaaaauauccaagaccaaauauaauaaauuaaagauggcagagcaagacauuccagauggauuuaucaaccgcgaccuaagaaacacucaauauauagcgaagaaagcgcuaagcauguuaaaugaaauaucuagaaggguaguggcaacaucuggcaccauuacagauaaacucagacaagacuggcaacuuguugauguaaugaaagaacuuaacugggaaaaauacaaagcauuaggccuaguagaauacuucgaagauaaagacggacgucaaauuggaaggauaaaagacuggacaaaacgaaacgaucaucgacaucacgcuauggaugcuuuaacgguggccuuuacaaaagauaucuuuauccaauacuucaauaacaaaaacgcuucccuaaauucaaacacaaacgaauacgcgauuaaaaacaaauacuuccaaaauggcagagcaauagcaccaauaccacuaagagaguucaggguugaagcaaagaaacaccuagaaaauacacucauuagcauaaaagcaaagaacaagguaguaacugguaacauaaacaaaacuaaaaagcgaggugggguaaacaaauaucuacaacaaacgccgagaggccaauuacauuuagaaacgauauauggaucuggcaaacaauaccuaacgaaagaagaaaaagucaacgcaucuuuugauaugaagaaaauagccacaguaaguaaaucugcuuauagagacguacuauuaaaacgacuccaugaaaacgacaacgacccaaagaaagcguuuaccgguaaaaauagucuagauaaacaaccuaucuggcuggauaaagaacaaacacgcaaagucccagaaaaaguuaaaacaguaacauuagaaaccauuuacacaguccgcaaagaaauaagcccagaccuuaaaguagauaaaguuauagaugcagggguaagaaaaauacuaacaggacgguuaaacgaauacggaaaugacgcgaagaaagccuuuagcaaccuagacgagaaccccauauggcuaaacaaagaaaaagguaucagcauaaaaagaguuaccauaucaggaauaucuaaugcccaaagccuacaugucaagaaagacaaagacggcaaacccauacuggacgaagauagcagaaauauaccaguggacuucgucaacacagggaacaaccaccauguagcugucuacagaagaccuguaauagacaaacggggucagcuaguuauugacgaagcuggcaacccuaaauaugaacuugaagaaguaguuguuagcuucuucgaagccguaaccagagcaaaccuaggucaaccaauuaucgacaaagacuacaaaacgucagaggguuggcaauuucuuuucaguaugaaacaaaaugaauacuuuguauucccaaaugagaaaacgggcuuuaaccccaaagaaauagaucuauuagacgcagaaaauuauggcguaauaucaccaaauuuauuuaggguacaaaaauucgcacauaaaaacuacguuuuucgucaucacuuagaaaccacgauuaaagauacaagcagcauacuaaaaggcaucacuuggauagauuuucgaagcucaaaaggcuuagaugcaauaguaaaaguuagaguaaaucacauaggccaaauagugaguguaggcgaauacuga

SEQ ID NO: 9167 - RNA, 4311 nt, Artificial Sequence
  Cas9 variant
augaaauauauuaaauacauucuaggucuugacauaggcagcaacucgauuggaugggcacuaauucaacuugauuuacuacagaaaacaaaacgcauaaucgccgccggauccagaauaauuccaauggaccaaaaaguucuauccgauuucgggaaagguauaacaauaucacccacagcucaaagaacaagcuauagaaaugcaagacacuguagggaacgucauuuacuaaggagagaacgacuacauagaguauuacauauucuagguuuccuccccacacauuacgacaaacaaauagauuucagcaaaagguauggcaaauucguugacaauacagaaccuaaaaucgcauacaaugaaggaaaauuucuauucauggauuccuuucaagaaaugcuuucagauuucaaaagucaccaaccagacuuauuuuacaccaagaaaaacggcgaagaauccaaaauacccuacgacuggacaauauacuaucuaaggaagaaagcccuaagccagaaaauaagcaaagaagaacucgcauggaucauccuaaacuuuaaucagaaaaggggauacuaccaacuacgggaagaagaaggaaauaaagaaaacgacuuugaaauaauuucgaguaaaauuauauccguuauuaagaaagacaaagacaagaaauacaacaaauauugguacgacaucauacuagaaaacggacuuguauaccaagcagccuucuauaaugauuucguauacaacuggaucaaccaagaucgugaauuuauaauagaacgaacaagucucaaaaacggugcugaaaaagucaaauugagcuacuuaccaacuuuugacgaaauagauaaaauggauaagaaagaacaagauaaauauuauaagaaaauaaaaaucaaaacagaaaacuccaucggaaacaaaacagucggauguuauaucuaugaccauauauuacaaaacccaaacgagaaaauaaaaggaaaauuaguuagaacaaucgaacgaaaauacuacaaagaagaauuaaaagcaauacuagaaaaacaaauagcauuacaacccgaauuauucacagaucaacuacuagcagauuguauuagagaauuauauuccaaaaacgaagcacaacaacguaaucuagccgcccgcgauuucguucaucuauuaguggaagacauuauuuucuaccaacgaccgcuucgucgucaaaaaucaaccuuagcaaacugcucacucgaauccagaucuuacaucgacaaagauucccauacucgaaaagaagcaccacuaaaagucuguccuaaaucaaaucccuacuaucaagaauuucgaguccugcaaugguuacaaaauuuaaaaauauacgaaauagacagcgaucaagaaguaacacaucaauucauaaaaacauuggaagauaaacaacaacucuuugaguuccuuauggcccaaaaagaaauugauugugaagaauuauuaaaauacuuccuuaaucaaacguaccccaaugcgaaagaaaaagcacuaaaaagcgaacucaagaaauggaaagauaccuauagauggaacuauguauaugauauaggagaaaaaucaaguaagaaauaccccaugaaugaaacacgauaugaauugaaaagacaccuagagaaaguagcuaaucuaccagaugauuucuugagcucagaaguagaauaccuguuguggcacuuaauauauagcguaaaagauaaaguagcauaugaaaaaggccucaagaaauuugcacagaaacaucacuuagacaaagacuccuucguagagucauuuaagaaauuuaacccauaccccucagaguauggaucauuuagcgaaaaagcuauaagaaaguugcuaccacucaugagauucggagcacacugggauuuuaaccacaucgacaaaaacacacaaaagagaauagaagaucucauaacugguguugaaaaugaagaaauacgaacaauuuuaagagaaaaagcagaaaaauaucaauuagaaaaagaaacagacuuccaagacuuaccacuuugguuagcucaauacauaguauacaaccgacacgcugaggcuucuucacuagagaaauggacauccguuaacgaucuagaaacuuaucuaaaugaguucaaacaacauagucucagaaauccaauagucgagcaaguaguaauggaaacauuacgaguaguucgcgacauauggcaacaauauggccaaggccaagcaucauucuuuaaugaaauacauauagagcuuggaagagaacuaaagaaaacagcaaaagaaagagaaaaauuaucuaaacaaaaccagaaaaaugaagauauaaaccugagcauaaaagaaaaacucaaagaauuagaaaaguauaauacaagagccuacucaauaacgcaucaagaaaaguacaaacuauggcuagagcaaaaacacauaaguccguacacaggccaaaucauuagccccgagaaucucuucacugauaacuaugaaauagaacacaucauaccacaaucucgauuuuucgaugacucauuaucaaauaagguagugugugaaucuauaguaaacaaagcaccauacaaagacagacaauuaggacuagaguuuaucaaaaaccaaggugggagaauaguuaaggaauuaaguaaagagaacaaaacuauuaaaaucuucaccgaagaacaauaucguacuuuuaucaaagaacacuacucaaauaacccagagaaaaccaagaaauuacuguuagaagaaauaccggagaaaaugguagcccgccaaaugaacgacaccuguuauaucucaaaauucauaagugaaauauuaaguaaaauaguaagaucugacgaacaggaugaaggaguccacagcaaaaacguuauacucuguacaggaaaaauaaccucaauccuacgacaagacuggggucugaacgauauaugggacaauuugauauuaccacgguucgagcgcaugaauaaccuucuacaaaaagaaaaauucacuauauacagcauagaaaaacagaagaaaauuccaguaguaccaaucaacgaccaauucaaaucuuuucagaagaaaagaauugaucaccgacaccaugccauggacgcaauuauaauagcaugcacgacacgugaacauauaaauuacauaaacaaccaacacgcacucgagaaggaaaaagauaagaaagaaaaacaagaggaaagagacaaacuaagggagaaauuaugcauaaagaaauauaauaaccgaucagaaggcaauuauucauggauauucaaaaagccgugggacaccuuuacccaagaaguaagagucgcacuugaggauauagucguaucauucaaacaaaaccuccgcguaauuaacaaagcaaccaauuacuaugaaagaugggucgaagaaaacggaaaauacaucaagaaaaugguaaaacaagaagggacaaauugggccauucgaaaaccgcuacacgaagaaacaauaaguggaaaaauauaccuggauagagagaaaauaaccaaaaacgacauacugacugcgacucgaaaaacaguagacucaaguuucgaugacaaacgaaucaagaaaaucacagauacaggcauacagaaaauacuccucaauuacuuaaaauauaaaggaagcccagaaauagcauucagcccagaaggccucgaagaacuaaacaaaaaccuaucaauauacaaugacggaaaaccgcacaaaccaauauacaagguacgaauauaugagaaaggaucagggcgcuuugcauuaggagaaaaagggcgaaaauacaaaaaguacguacaaggcgcauccaaccuauacuuugguauuuaccaaggagcaaaacggaguuuugccacaauaccgcucaacgaaguaaucgaacgacaaaaacaaggucucccaucaguaccagaguacaaugaaaaaggcgauuuacuauuguucuccuuauccccaaacgaccugguuuauguaccuauagaaggcgaaauaauagaaaauauagacuucaggaaccuuaguaaagaacaaaaagaacgaauauauaacguaaacgacuuuagcaguacaugcuauuuuacgccaaacagaaucgcaaaagccauauuuccuaaggaaguugauuuacagaggaaaggagauaaauuaagcgggucuuacgacacaaaaacggcaagccuugaagggauacaaauaaaagaaguuuguauuaaguuaaaaguagaccgcuuaggcaacauaaguaaagcauga

SEQ ID NO: 9168 - RNA, 4314 nt, Artificial Sequence
  Cas9 variant
augaaauacauaaaauacauacuuggucucgacaucggcagcaauucuauuggcugggccuuaauccagcuugaucugcuacaaaaaaccaaacgaaucauagcgacaggaagcagaauaauacccauggaccaaaaaguccuaucagauuucggcaaaggcauaacaauaucaccuaccgcacaacgaacgucuuaucguaaugcgagacauugccgagaaagacaccugcuccgaagagaaaggcuacauagaguccuacauauccuugguuucuuaccaacacauuacgacaagcaaauagacuucuccaagcgcuaugguaaauucguugauaauaccgaaccgaaaauagcuuauaacgaaagaaaauuccuauucauggacagcuuucaagaaaugcuagcggauuucaaaauccaccaaccagaccuauucuacacaaaaaagaauggugaggaaucaaaaauaccauacgacuggaccaucuacuaucuaagaaaaaaagcacugucacggaaaaucaguaaagaagaacuagcguggaucauuuuaaacuuuaaccaaaaaagagguuacuaccagcuaagagaagaagaagaggaaaauaaagaaaaugauuucgaaaucaucaguucgaaaauuauaagugugauaaaaaaagauaaagauaaaaaauacaauaaauauugguaugacauaauucuggaaaauggauuaguauaccaagcugccuucuauaaugacuucguauauaauuggauaaaccaggaucgcgaauucauaaucgaaaggauaucauuaaaaaaugguaccgaaaaaguaaaguuaucauaccuccccacauucgacgaaauugauaaaauggacaaaaaagagcaagauaaguacuacaaaaaaauaaaaauaaaaaccgaaaacagcauaggaaacaagacagugggaugcuacauuuaugaccauauacuccaaaauccaaaugaaaaaaucaaagguaaacuaguacgcacaaucgaacgcaaauauuacaaagaagaacugaaagcaauauuagaaaaacagguggcacuacaacccgaauuauuuacagaucaauuauuugcagacugcauacgagaacuuuacaguaaaaaugaagcacaacagagaaaucuagcagcuagagacuucguacaucuauucguagaagauaucauauuuuaucaacgaucauuacgacggcaaaaaaguacccuagcaaacugcucucuugaaucuagaaguuauauagacaaagacucgcauacaagaaaagaagcaccauuaaaaguuugcccaaaaucaaauccauacuaucaagaauuccgcguacuucaaugguuacaaaaccuaaaaauauaugagauagacacagaucaagaaguuacacaugaguuuauaaaaacucuagaggacaaacaacaauuuuucgacuuccuaaugaaucaaaaagaaauagacugugaagaauuacuaaaauauuucuuaaaucaaacauacccaaaugcacgcgagaaagcccuaaaaagugaauuaaaaaaauggaaagacacauauagauggaacuacguuuacgacauaggggaaaaauccucaaaaaaauacccaaugaaugaaacccgauaugaguuaaagagacaccuagagaaagucgccaaccuaccagacgauuucuuaucuucagaaguugaauauuuacucuggcacuuaauauauucagucaaagacaaaguagcuuaugaaaaaggccugaaaacuuucgcucaaaaacaucaucucgauaaagauucauucguagaaucauuuaaaaaauuuaagcccuauccuucagaauacggaucauuuucggaaaaagccaucagaaagcuacucccccucaugagauucggauccuauugggacuuuaaccacauagacaaaaacacacaaaaaaggauagaagaucucauaaccggcguagaaaacgaggaaauaagaacaauuuuaagagaaaaagcugagaaauaucaacuagaaaaagaaaccgacuuccaagauuuaccgcuauggcuugcacaauauauaguauauaacagacacgcagaagccucuagcuuagaaaaauggacguccguaaacgaccuugaaacauaucuuaaugaauuuaaacaauacucacuaaggaauccaauaguagagcaagucguaauggaaaccuuacgaguaguccgagauauauggcagcaauacggacaaggacaagcaagcuuuuuugacgaaauacauauugaacuaggacgcgaacuuaaaaaaacugcaaaagagagggaaaaacucuccaaacaaaaucaaaaaaaugaagacauuaacuuauccauaaaagaaaaacugaaagagcucgaaaaauacaacacucgagcuuacaguaucacacaccaagaaaaauauaaacuauggcuggaacagaagcauaucagcccguacacagggcaaauaauaaguccugaaaacuuguuuacggauaacuaugaaauagaacauauaauuccacaauccagauucuucgaugacagccuaucaaauaaaguaguuugcgaauccauaguaaacaaggcaccauacaaggauagacaauuaggccucgaguucauaaaaaaucagggaggaagaauuguuaaagaguuaagcacagaaaacaaaacaauuaaaauauucacugaagaacaauauaggacuuuuaucaaagaacacuauaguaauaacccagaaaaaacuaaaaaauuauuguuagaagaaauacccgaaaaaaugguagccagacagaugaaugauacauguuauaucuccaaauucauuagcgaaauacucucaaaaauaguucgaagcgacgaacaagaugaaggcguccacucaaaaaacguuauccuauguacaggaaagauaacaagcgcauuaaaacaagacuggggagucaaugauguuuggaaugaccuaauacugccaagauuugaacgcaugaacgaccuaacacaaucaacacuauuuacaacauacaacgaaaaauaccagaaauaccuaccaacuguacccauggaauacucaaaugguuuccaaaaaaaacgcauagaucauagacaucaugcgauggacgcaauaaucauagcaugcgccacacgagaacacauuaacuauauaaacaaucaacacgcauuagaaaaggguaaagauaaaaaagaaaaacagaaggaacacgacaaacuccgugagaaauuauguaucaaaaaagauaauaagggcucagaggaaaacuauucauggauuuuuaaaaaaccuugggauacauucacucaagaaguccaagccgcacuagaaggcaucguuguaaguuucaaacaaaauuuaagaguaauuaauaaagcgacaaacuauuacgaaaggugggucgaagaaaacgguaaauauauaaagaaaaugguuaaacaagaagggacuaacugggcuauaagaaaaccucuacacgaagaaacuauaucaggaaaaauauaccuagaccgugaagaaaucacuaaaaaugauauccuaaccgccacaaggaaaaccguagauucaaguuucgaugaaaaaagaauaaaaaaaaucacagauacaggaauacagaaaauacuacuaaauuaccuuaaauacaaagguucaccagaaauagcauucucaccagaaggucuagaagagcuuaauaaaaaccuuagcauauauaaugacgguaaaccucauaaaccaauauauaaaguccgaauuuaugaaaaaggaaguggaagguucgcucucggagagaaagggcgcaaauacaaaaaauaugugcaaggcgcaccaaaucuauacuuugguauuuaccaaggcgcaaauaaaagaagcuucgcaacaauaccacuaaacgaaguaauugaaagacagaaacaaggucgacccaguauccccgaauacaacgaaaaaggcgauccacuucucuucagccuuucaccuaaugaccuaguauacguacccguggagggagagauaauagaagacauugacuuucaaaaucuaaguaaagaacaaaaagaaagaauauacaaugugaaugacuucagcaguacgugcuacuucacacccaauagaaucgcaaaagcuaucuuuccgaaagaaguagacuuacaacgcaaaggcgacaaauuaccagguaguuacgacacaaagacagcaucacuagaagguauccaaaucaaagagguaugcauuaaacuuaaaaucgaccgguuaggaaacauaaguaaggcuuga

SEQ ID NO: 9169 - RNA, 4317 nt, Artificial Sequence
  Cas9 variant
augaaaacuauacucggauuagaucuaggaacuaacucaauaggcugggcacuaauaaaacaaaacuucgaaaacaaauacggagaaauacucggcaugggaucucguauaauaccaaugagccaagacauauugggagaauuuggcaaaggcaauucagucucucaaacugcagcccguaccgacuaccgagcaacacgacgacuccgcgaaagguuuuuauugagacgagaacgacuccaccgagugcucaacgucuuaaacuuuuugccagaacacuaugcaucacaaauagauuucgacaaacgauuuggaaaauucaaaguagaaacagagccgaaacuagcauggaaaaauauagauggaaaauucucguucuuauuucaaacaaguuuuaaugaaaugcuagaagacuucaaagcgcacggacaagauuugaaaguaccauaugauuggacgaucuauuauuuacggaagaaagcacugagucagaaaauagaaaaagaagaacucguuuggauccuauuaaacuucaaccaaaaacgaggauacuaucaacuaaggggagaagaagaagaagaaaacccaaauaaacuaauugaguucuauucuuuaaaaauaauagauguacuggccgacgaaccacaaaaaggaaaaucagacauuugguauagucuaguccuagagaauggauggauauauagaagaaguucaaaaacaucccuauuagauuggaaagacaaaauuagagauuuuauugugacuacggaucucaacgacgacggaucaguuaaaaccgacaaagaaggaaacgagaaaaggagcuuucgagcaccaggggaaaaugauuggacucuagucaaaacaaaaacagaacaagaaauagaccgaagucggaaaacaguaggaaacuauauauaugaaacauuauugcaaaacccgaaacagaaaauaaaggggaagcuaguaagaacaaucgaaagaaaauuuuacaaagaagaauuaaagaggauauuagaaaagcaaaaagaauuucaccgagaacucgaaucuaaugaccuuuacaacgauuguauaagagaacuauacagaaauaaugaagcccaucaacuaacacuuagcaaaaaggacuuuguacauuuauucauggaagacauaauauuuuaucaaagaccacucaaaucacaaaagagcucaauaucaaacugcaccuuagaauuucguaaauauaaagacgaaaauggaauagaacacacacaauuucuaaaagcgauuccaaaaaguaauccguauuaccaagaauuucgaauauggcaauggauauucaaccuaaauauauauaagaaagauaacgacgacaauguaacaaaagaauuuuugaauacuacacgcgacuuugagaauuuauuugaguucuuaaauaaccgaaaggaaaucgaacaaaagccccuacuaaaguucuuauuagaacagaaagaauuuaaagggaaauuauuaaacgcagaaacagaaaaauuuagauggaauuacguugaagacaagaaauaccccuguaacgaaacuagaacuaugaucucggaacgauuaaagaaaguggaaaauauaagcgaugacuucuuaacgagggaaauggaacagaaaaucuggcacauaauauacagcguaaaugacaaaaccgaauaugaaaaagcacucaaaucauuugcggaaaagaacaaccuugacgaaaauagucucuuugaagccuucaagaaacuaccaccuuucaaaucagaauacggaucauuuagcgaaaaagcaauaaagaaacucuuaccauuaaugagacuagguaaauauuggucauacgcaaaaauagacuuauacucuaaaaaucggauacagaaaauaauaacgggggaauuugaugaaaacaucaaagauagagugagagaaaaagcaauaaggcucacagcugaaaaugauuuccaaggcuuacaauuauggcuagcccaauauauaguauacggccgacacucagaagcaagcaugauugguaaauggaacucugccgaugauuuggaagaguuccuaaaagaauuuaaacaacacucauuaagaaauccaauaguagaacaaguaauuacugaaacccucagaauuguaaaagauauauggcucaaauacggaaauggagcaaaagacuucuuuaaugaaauacacauagaauuaggacgcgaaaugaaacaaacaaaagacgaacgagccaaugcuaccaaaacuauuacagaaaaugaaaauaccaaccuaaggaucaaagcacuacuugcagaaaugaugaacgaucacaguguugaaaacguucgcccuuacucccccaugcaacaggaaauccuaaaaauauaugaagacgguauauuaaagagcgacauagaaaucgacgacgauauauuaaaaaucucaaaaacagcacaaccaucaucuucggaccuuaaaagguacaaacugugguuagaacaaaaauacaaaagcccauauacgggccaaauuauuccguuaaacaaacuauuuacaccugaauacgaaaucgaacacaucauuccacaaucaagauauuuugacgacaguuuuucaaauaaaauuauaugcgaaucugcaguaaauaaauuaaaagacaacuacauuggauuaggauucaucaaacaauuuggaggaacaauaaucgaaugcggcuucgguaaaagaguaaagguauucgaagucggagaauaugaggaauuuguuaagaaacacuacgcuaauaaucgcggaaaaagaaacaaauugcuccuagaagaaauaccugagaaaaugaucgaacgacaaaugaaugauacucgacacauaucaaaguauaucagcgggauauugucccacaucguaagaguagaagacgggacggacgaaggaguaaacuccaaaaacguaauaccaggaaacggcaaaauaaccacgcaauuacgacaggacuggggacuaaaugauguauggaacgaauuaauacuccccagauucgaacgcaugaaccaacucacaaauaguacugauuuuacaucauggaacgaaaaccaucaaaaauacuuaccaacagucccugucgaguucaguaaaggauucuccaagaaacgcauagaucauagacaucacgcuuuagaugcacuuguaauugccugugcaacaaaagaucacguaaaccugcuaaacaaccaaucagcaaaaucagccacaaaacgcuaugaucuaaagaagaaauugaugaaauuugaaaagaccgucuauaaagacccucaaacagagaaaagaauagaaagagaaguaccaaaacacuuucuaaaacccugggaaacauuuacagucgaugccaaaaaucgacuugaaacuauaauagucaguuuuaaacaaaaucugcgcguaaucaacaaagcaacgaacuauuacgaaaaauacguagaaaaagacggagugaugaugaaagaaagagucgaacaaacaggaacaaacugggcaauuagaaaaccaaugcacaaagaaacagucuccgguaaaaucgacuuacccuggguaaaaguaccaaaaggaaaaauauuaaccgcgaccaggaaaucuuuagauaccucguucgauuuaaaagcaauagcaucuaucacagacacugguauccagaaaauacucaaaaauuaccuagaauuuaaggaaucaccagaacuugcguuuaguccagaaggaaucgaagauaugaauaagaauauagaaaaauauaauggaggacgcccacaucaaccaauaucuaaaguucggguguuugaguuggguucaaaauuccaaguugggcaaacuggaaauaagaaagauaaauacguugaagcagcaaaaggaacaaauuuauuuuucgcaauauacgaagacaagaaaggaaaacgaucguaugaaacaauaccacuuaacgaagugauagaacgacagaaacaaggacucagcguaguagacuugaaaaacguaaacgacuuuuucuuaugccccaaugacuuaguuuacauaccaucgggagacgaauuugaaaacagaggaucaauagaaauagagaauaucaccaaagagaaaagugaacgauuuuauaaaguagugagcuuuaguggcucucaaauuuucuuuguaagacaugauauagccguaagcauaguaaauaaaggugaguucagcacacucaauaaaauggaaagagcaauugauggcuccauggucaaagaaauaugcauaaaacuaaaaauagacagauuaggggaugucuuaaaagccuga

SEQ ID NO: 9170 - RNA, 4317 nt, Artificial Sequence
  Cas9 variant
auggucaagaaaggguacacaauagggcucgacauuggaacaacaucaguuggaugggcagugaccgacgaugacuucgagcuaguuaacaaaaagaugucaauaaaggauaaaucugguaguaccauuaaacgaguaaggaaaaaccucuggggagucagauuauuugacgaagcaaaaacagcggaaaauacaagaagaacaagaggaguacguagacgcauuagaagacguaaagaacgacuaaacuaucuccaaggcauauucucaagugaaauggcuaagauggaugaaaauuucuuuaugcgauuagaagaaucguuuuucaaguuaagcgauaaaucagaacaaaauaaauuucccuacgccuuauuuaaaaaugaaauagaagaaaaagcguauuauagacaguucccaacaauauaccaccuaagaaaacaucucauggaacacgaagaaucagaccuacgaaaaauauacuuaggauuacaccauauuuuaaaauacagaggccauuucguacaagaaggccaaaagauggauguagcgaacauagacauacaaggaaauuugaaagaauuauuuaaugcauuaaaugaaaauuuuuccaacaaagaggacgacuuugaacaagagagaaugaaagacggagucaaacgagcaaaaguacucuucgacacggaaaaauuggcugcuguggaagaaauauuaaaggagaaaauaucaaaaucauggaagguaaacaaaauaucaaaagggauacuugcagaaaagaaggaucuaccaauuuuuaaagcaauagucggcaacaaaauugacuuagcuggaauauucgauuguccagauuacgcagaaaaaguaaaugaaucgauaaaggaauugaaagacaaagucuauuuuaacaaagaagauuuugaggaaacauucgaaaaacugucccaacuacuuaaagaagaggagcuagaaauauuaauucuagcaagaaagugcuaugaggcagugcuauuagcagauauaaugcaaggugaacagagcuuaucagacgcaaugguagcaaaauacaacgaccauaagaaagaccuagugauauucaagaaauuuguaaucgacuacuucucagaagauguguacuuugaccuguucaaaaacacacagcucgccgggaacuaucacagcuacguaaaaggagaaagaaaagguaacaaauucaaucacgcaucucuugacgauuucuauaaauuuguaaagaaagaauuagauaagaaagcagaggaacuaucagaacauccgguuuauaaacaaauauuacagaaaauagaauuggaaacauuccuaccaaaacaaagaauguucaaaaauggugcaauaccuuaucaagugcauuuacaugaacuucgagccauaauaaagaaacaagagaaaagauuuccauuccuugcugagaaaauaaucauuaaagacaaccagaaagauauauccgaauacaagaucgaaacacuaaugaaauuccguauaccauauuacguagggccacuaauagaagcacgugaaggagaauugggaaagaaacgcacaaauuacagcagauucgccuggaugcaaaaaucacccgaaagccagaacauuggaauaacucccuggaacuuccacuccguuguagauaaagacgcaucagccagugaauuuauugaaagaaugacagguuuuuguuccuacuuuccagaagaaccaguuuuaccuaaaaacucauuaauauaccaacaauucacgguguuucaagaauuaaguauaguaggauauuacgacgaacagaacagaaaacacuaucucgauggggaaacaagaagaagaauauucgaagaccuuuucaagaaaaaucgaacuguaucagcaggacuacugagaaaaugguugguaugcaaccaaaggaccagccaagaagaaaaagaaauuagguuauucggauuagaccugaagaaaaacgggcugggcucuggaaauuucaauacaaaauauacaacauaccuagacuuaaaagaugcuggaauaacagaaaaacaauuaaaacaacacaaagacuucuuugagaaaauaguaaaauaccaaaccaucuuugaagacaagaaaauccuaaaaagaagaauaauccuuuugaacgaagaacaaccacuacuaucagaagaacaaaucaaaaacuuagcaaagaaacacuacacaggguggggaaaccuaagucuuaaacuaauagauggcauacaggauaaaggaaaaacgaucuuagauuaccuggaaacccaagauuauaaucaaaacuugaugcaacuaaugaaugaugaaaauaaaaguuuugaaaugcaaauagaacaagcaagagcaggaaaaguccaauuuggaaaaauagauuacagcuucgucgagcaauuagcuggcucaccagcaaucaaaagagguauauggcaaucacuucaaauaguagaggaauuagucgcguuuuuaggcaaagaaaacauaaagaaaaucguaauagaaauggcuagagaaaaucaaucaucuaaaagaacgaaaaguagacaaaaacaaauagaagcgcuguaucaaaaagucacuggagaccucaaaaaugaacaagagaaaauagauguaaugcaaaauuuugacaaugaaagagucuucuuguacuaccuacaaaacggcaaguguaugcacagcggggaaaaacuagaacucucgcagcuuagcgaauacgaaauugaucacauaauuccacaaacauacaucaaagaugacucauucgauaacaagguacuugucacacgaaaugcgaaucaacaaaagggaggggacgucccaaguuacgauguaaucgauaaaaugaaaucauacugggaaaaguugaaagaaaacaaccuaauaagcgaaaagaaauuugcaaauuuaacaaaagggaaauuugacgaccaacagcugucaggguuuaucaaucgacagcuaguggagacaagacaaauaacuaagaacguagcgauuauacuagauaaaauauacaacgaugaagcuaaaaacgaaaaagaaguagcaauaaucacgcuaaaaagugcucuaacaagccaauauagacaaggcauaauauacguaccaaacgacgacuuugacgagcucaaauuaguaaguaaaacuaacagcaggcuaaaagaaguuaaacuacacgacggcuucuauaaaguuagagaaauaaacgauuaucaucacgcacacgacgccuaucuaaauaauguaguugcaacauauuuauacgaagccaugccugaccuuagaccauuauucguguacggagaacauuccagagaaauacacaaacgauuuuuaggaaaauacgcaacaacaagaaaaggccaauucaaacaacugcuaguagacaugcaagacgaauauuggaugaggaaagauaaagaaggaaacuuuauagauggagaaauacuauggcgaagagacgagguacuacaaauagugaagaaaguauuagauuauagaaauauacaaaucaccaagaaauuagaaaugaugguaacaggaggcgaagaaaaaucuuuuuaucaagauucacgauguagaaaagauaagacagcaauaccauacaaaacaaacugggauccaucaaaauauggaggguucaaaucaccacgaacugcguaugcaaucccaguaaucaagaaaaauaaaccaaaacuugagccaguacuuuuaguaaauagaagcaaaguugaaacagauggacaguucgauugcgaaaaauuuaaagaacucaaccccacauuaaagauucuaggacaaccaauauggaaauaucaaaguuuugaaauguucgacgguacuaaacgguauauagcgucagcauccgaaauacauaagggaaaccaaauaaaauuuagccaagaacacaugaaauuuauuuccuguugucagaaauacgacgaagucaaaaauaaacuagcguucgauuuuguaaacgaaucaaaacacuuauuucaggaaauacuaacagcaauuaaagacaauauucauagauaccgcuuaauagcugaaggaauugaaguacaucgcaaauucagcaacauguuagaaaauauagaaaaacuaucuacacaagaguuaguagacaacuuacuagacgcuauaaauauaacgucuguagguaccacaaauaaugcauucggcagaguuagauacaaggguuccuaccuaaacgaaauaugguccgcaacacugauucaccaaagcguuaccggccuauaugaaacacgugaaaaauuaauauga

SEQ ID NO: 9171 - RNA, 4323 nt, Artificial Sequence
  Cas9 variant
augaaaacaauauuaggcuuagacuuaggcacaaacuccauaggcugggcgcuaguagaacaagacuucgaaaacaagcaaggcuuaauacucggaaugggaagccgaauaauaccaauggaugcagguauuaucggcaaauucgcugaaggguccucaauaucccagacugcagaaagaacaggauacagaucuauaagacgauugcgugaacgacaucuauuaagacgagaaagacuacacagaguucugaauauccuaaaauuccugccagaacauuacgcagcagaaauagacuucgagaaaagauuuggacaauuuuuagcugaaacagaaccaaaacucgccuggaagaaaagcgccgaaggaaaauuugaauuucucuuccaaagaucauuugaugaaauggucgcagauuuuaaagcaaacggacaagauauuaaaauaccuuacgacuggacaauauacuaucuacgaaagaaagcguuaacacagaaaaucucaccacaagaguuagcauggauaauauugaauuuuaaccaaaaacgaggguacuaccaacuaagaggagaagaggaggaagagaacccuaacaagaaaguagaguuuuacucacucaaaaucguugaugucguugcugacgaacaaccaaauaagaaaggagacaccugguauucgcugcaucuagaaaauggaugggucuacagacguucaucaaaaaucccauuauaugauuggaaagauaaaguccgcgauuucauuguaacuacugacauaaacgaagaugggucagaaaaauuggacaaagacggugaggugaaacggucauuccgagcaccaaaagaagacgacuggacccuaaucaaaaagaaaacugaacaagaaauagaacaauuuaaccaaacgguaggaagcuacaucuaugaggcuuuacuugacaauccaacacagaaaauaagaggaaaacugguaagaaccauagaaagaaaauuuuacaaaucagaacucaagaaaauauuagaaaaacaaauugaacuacaacccgaauuauuuacagaagaucucuauaacgcaugugcuagggaacuuuaucguaguaauguagcacaucaacaacaacuuucaagucgcgauuucgucuaccuauuucugaacgacauaauuuucuaucaaagaccccuaagaagccagaaaagucuaauaaguaauugcagucuggaauuuagaacaauaaaagacaaagauggaaauggccaaauaauauacuuaaaggcaauaccaaaaaguaauccguauuaccaagaguucagagucuggcaguggcuauauaauuuaaagauauucacaaaagaagacgacaaagacguaaccaaccaauuuauaaacaaaguggaagaccuagaggcucuauuugaauuucugaugaaccaaaaagagguuaaccauacggacauucuaacuuacuuaauagaaccaauaguaaaaaguaaauacccgaaugcaaaaggaaaagccuuuaaagacgaacucaagaaagaauuaaagaaauauagauggaacuauguauaugaugcagauaaagacgagucaaaaagcuacccuaugaacgaaaccagauacgaacuaagaaaaagacuggacaaaguugaaaauguaccagcagauuuuaugacacgcaaaauagaacaacaccucuggcacauaauauauucaguaacagauaaaauagaguucgaaaaggcuuuaaaaucauucgcaaauaaauaugaucuacaucaagaauccuuuguagagaauuucaaacgcuucaaacccuucgauucagauuacggaaccuacucagaaaaagcgauuaagaaauuguugccuuuaaugagaguuggaaaauacuggagcugggaaggcauagacaauaauacaaagaaaagaaucggaaaaaucauaacaggagaguacgacgaaaccaucaaaaaucggguccgugaaaaagcaauagaccucacagaagaaaaccacuuucaaggacuucaguuauggcuagcccaauacaucguauaugaccgucacagugaagccgauauugcagguaaauggaacaguguagccgaucuagaacaauauuuaucagaguucaaacaacauucauuaagaaauccaauaguggaacaaguuauaaccgaaacacuaagaguaguuagagacauauggaaacaauauggaaaaggugccaaagauuauuuugacgaaauacauauagaacuaggacgugaaaugaaaaauacggcagaagaaagaaaaagacuguccuccauaauaagcgaaaacgaaacgacaaaucugagaauacgagcaauucuagaagaacucauguaugacgaaaacauggaaaacgugagaccauauucaccuaugcaacaggaagcucuaaaaauauaugaagacggcguacuuaguucuucaguugaaauuccagaagacauagagaaaaucuccaagaaaagcgaacccacaaaaucagaaauccaaagauacaaacuauggcuugaacaaaaauacagauccccauauacaggaaggccaauuccauuauccaaauuguucacaccagccuaccaaauugaacacauaauaccacaagccagguucuucgacgauggauuuucaaauaaaguaauaugugaaucugaaguaaacgcucucaaagacaaaauguuaggacuagaauuuauccaaaauuacuacggucaaaaaguuaccacgucauucggagaaguaacaauacucacagaagaugcauacaaggcuuucgugaaagaacacuacgacaaaaacagaucgaaacgaaacaaauuguuauuggaagagauaccggagaaaaugauagauagacaaaugaacgauacgcgauacaucaguaaauacauaucaaaaguucuaucaaauuuaguuagaggugaaaaagaugacgagggcguuaauagcaaaaacauaauacccggaaacgguaaaauaaguggcacucuaaaacaagacuggggacuuaaugauguauggaaugaccucauauuaccaagauucgaaagaaugaaccagcuaaccaauagcacagacuucacagccuggaaugaaaaacaucaaaaauuccucccgaccauuccacuagaacucuccaaaggcuuccaaaagaaaagaauagaccacagacaccacgcacucgaugcauuaauaauagcaugcgcaacccgugaccauguuaauuuacuuaacaauaaacacgcaaaaucgcgaaacgaaagauaugaccuccaacauaaauugcgacauaccaccccauggcaagauaaagaggguaaaguccgcaccaaauuuacggaguucaagaaaccaugggaaacuuuuacucaagacacuaagaaagaguuagagaaaauaguaguauccuucaaacaaaaucucagaguaauuaauaaagcaaccaauuauuaugagaaaauugucgauggaaagaaagucauguuuaaacaagaaggaguaaacugggcaauacguaaaccaaugcacaaagaaacaguaucaggaaaaauagaucuacccagaguaaaaguaagcaaaggaaaaauuuugacagcaacaagaaaaucacuagacacauccuuuaacgcaaaaacaaucuuaagcauaacagacacuggaauacagaaaauccuguugaauuauuuaaaagccaaaggaaacccggaacuagccuuuagccccgagggaauagaagaaaugaaccaaaauaucagcuuauauaaugacggaaaaccacaccaaccaauacuuaaaguaagagucuuugaacaaggaucaaaauuuccacuaggcgaaacaggaaauaaaacaaccaaauacguagaagcggcaaagggcacaaaccucuucuuuggaguguacgaaaacaaccaagguaagcgauccuacaacacaauaccucuaaaccugguaaucgaaagacaaaaacaaggauugaacagcguacccgaaacuaaugaaaaaggacauagauuguuauucagucuuagccccaaugacuuagucuacguaccaaucgaaggugaagucuuugacaaaaccaauccagacguaaacagaauuuacaagauaguguccuuuucaggcucacaaauguuuuguguacgccaggaugucgcaacuagcauugucuauaaauuagaauuuagcagcuuaaauaagauggaaaggaccauagacgguauaaugauaaaagagauuuguauuaaauuaaaagucgaucgacucgggaauauaaguaaagccuga

SEQ ID NO: 9172 - RNA, 4323 nt, Artificial Sequence
  Cas9 variant
augaaaacaauacuuggucucgaucuagguacuaauuccauuggaugggccuuagucgaacaagauuucgagaacaaacaaggucuaauacuaggaaugggaaguaggauaaucccaauggaugcaggcauaauaggaaaauuugcagagggaagcucaauaucacaaaccgcagaaagaaccgguuauagaagcaucagaagauuacgggaacgacaccuccugagaagagaaagacuacauaggguauuaaauauacugaaauuuuuaccugaacacuaugccgcagaaauugacuucgaaaaacgauucggacaauuucuagcagaaacagaaccaaaauuagcauggaagaaaaacgcagaagguaaauucgaauuuuuguuccaacgcucauucgacgagaugguagcagauuuuaaagcaaacggucaagacaucaaaaucccuuaugauuggacaauuuacuacuuacgaaagaaagcacuaacucagaaaauaucaccacaagaacuggcguggauaauauuaaacuucaaucaaaaacgaggauacuaucaauuacggggagaagaagaagaagaaaacccaaacaagaaaguugaauuuuacagcuuaaaaauaguagacguaguagccgaugagcagccuaacaagaaaggugacacaugguacucuuuacacuuggaaaacgguuggguauauagaagauccagcaaaauuccacuuuacgacuggaaagacaaaguaagagacuuuauaguuaccacugacauuaaugaagauggaucggaaaaacuugacaaagacggcgaagucaaaagaucauucagagcaccaaaagaagacgacuggacauuaauaaagaagaaaacagaacaagaaaucgagcaguucaaccaaacuguaggcucuuauaucuacgaggcgcuacuugacaauccaacgcagaaaauaagaggaaaauuggucagaacaauagaaagaaaauucuacaaaagcgaauuaaagaaaauacuagaaaaacaaauugaauuacaaccagaacuauuuacagaagacuuauauaaugccugugcucgagaauuauauagacgaaauguagcccaccaacaacaauugucaucacgagacuuuguauacuuguuucuaaacgacauaauauuuuaccaacguccacuuagaucacaaaagagcuuaauaaguaacuguagucucgaguuuagaacaaucaaagauaaagacggcaauggccaaauaauuuaucuaaaagcaauaccaaaauccaauccuuacuaucaagaguucagagucuggcaauggcuauacaaccuuaaaauuuuuacaaaagaagaugacaaagacguaacaaaucaauuuauaaauaaaguagaagaccucgaggcauuauuugaauuucuuaugaaccaaaaggaaguuaaucacacagauauauuaacauaccuaauagaaccuaucguaaaauccaaauacccuaaugcgaaaggcaaagcauucaaagacgaacuaaagaaagaauuaaagaaauacagauggaacuauguauaugaugcagauaaagaugaaaguaaaucauauccuaugaacgaaacaagguacgaauuacgaaaaagacucgacaaaguagaaaauguccccgcugauuuuaugacucgaaaaauagagcaacaccuauggcacaucauauacucagucacugacaaaauagaauuugaaaaagcauuaaaaucauuugcuaauaaauacgaccuccaccaagagagcuucguagaaaacuucaaacgcuuuaagccguuugauucagacuaugguacuuacagcgaaaaagcuaucaagaaauuauugccguuaaugcgagugggaaaauacugguccugggacaucauagacgauaaaaccaaaacaagaauuggaaaaauaauuacaggagaauacgaugaaacaaucaaaaacagaguaagggaaaaagccauagaccuaacagaagaaaaccauuuccaaggacuacaauuaugguuagcccaauacauagucuaugaucgccacuccgaagcagauauagcagguaaguggaacucuguagcugaucuagaacaauaccuuagugaauuuaaacaacacucccugaggaauccuaucguagaacaaguaauaacagaaacucugagaguaguccgagacaucuggaaacaauauggaaagggcgcaaaggauuacuucgacgaaauacauauagagcuagguagagaaaugaaaaauacagcugaagaaaggaaacgauuaagcuccauaauaucagaaaaugaaacaacuaauuugcgaauacgagcaauacucgaagaauuaauguacgaugagaacauggaaaacguaagaccauacucaccaaugcaacaagaggcacuuaaaauauacgaagauggcguacugucuagcucaguugaaauacccgaagacauagagaaaaucuccaagaaaucagaaccgacaaaaagcgaaauccaaagauacaaacuguggcucgaacagaaauacagaucaccauacacaggacgaccaauucccuuaaguaaacuuuucacgccugcguaucaaauagaacacauaauaccccaagcuagauuuuucgaugacggauucucaaauaaaguuaucugcgaaagugaagugaacgcauuaaaagacaaaauguuaggguuagaguucauacaaaacuacuaugggcaaaaaguaacgacauccuuuggugaaguaacaauacucaccgaagaugcauauaaagcauucguaaaagaacacuacgauaaaaacagaaguaaacguaauaaacuacuccucgaagaaauuccugagaaaaugaucgacagacagaugaaugacacacgauauauaucuaaauauauaaguaaaguuuugagcaaccucguacgaggagaaaaagacgacgagggaguaaacagcaaaaauauuaucccaggaaauggaaagauaacaggaauacuuaaacaagacuggggacugaacgacguauggaaugaucucauuuuaccuagauucgaacgaaugaaccaauugaccaauucaacggauuuuacugcuuggaaugaaaaacaucagaaauuccuaccuaguguaccacuagaacuaagcaaaggauuccagaagaaaagaauagaucacagacaucaugcacucgacgcauuaauaauagcuugcgcaacacgagaccacguaaaucuauuaaacaacaaacacgcaaaauccaggaaugaacgauaugaucuacagcauaaauuacgccacacaacucccuggcaagacaaggaagguaaagucagaacaaaauucacugaauuuaaaaagccaugggaaacauucacacaagacacuaagaaagaacuggagaaaaucgugguaaauuuuaaacaaaaucuaagagucauuaacaaagcaacaaacuacuacgagaaaauaguagacgguaagaaaguaauguuuaaacaagaaggaguaaacugggccauacguaaacccaugcacaaagaaacagucagcggcaaaauagacuuacccaggguaaaaguaucaaaaggaaaaauacuaaccgcaacaagaaaaucucuagauacaaguuucaaugcaaagaccauacucucaauaacagacacaggaauacagaaaauccugcuaaacuauuuaaaagcaaaaggaaauccagaauuagcauuuucacccgaaggcauagaggagaugaaccaaaacaucagccuauacaaugacggaaaaccacaucaacccauacuuaagguucgaguauuugagcaaggcucaaaauucccucuuggugaaaccggaaacaaaacaacaaaauauguugaagcugccaaaggaaccaaccuguucuucggaguguacgaagacaaucaaggaaaaagaucguaugauacuauaccccugaauauaguuauagaaagacaaaaacaaggacuaaauagcguacccgaaacuaaugaaaagggacaccgauuacuguucagccugucaccaaaugaccuggucuacgugccuauagaaggagaaguauucgaugaaaccaauccggacguaaacagaauauacaaaguaguaucguucucgggaagccaaauguuuuguguuagacaggacguagcaaccucgauagucuacaaacuagaauuuucauccuuaaauaaaauggaacguacaauugauggaauuaugauaaaagagauauguauaaaacuuaaaguagaccgcuuaggaaauauauccaaagcuuga

SEQ ID NO: 9173 - RNA, 4332 nt, Artificial Sequence
  Cas9 variant
augaucaaguuacuguacuuggaaaaacugaaacaauauacaaugaaaaaaauacuaggacuggauuuaggaaccagcaguauuggaugggcccuuguuaacgaagccgaaaauagcgaugaaguaaguucaaucauaaaacucggaguucgcgucaauccacuuaccguagaugaaaugcaaaauuucgaaaaaggaaagaguauaaccacaaaugccgaccgaacgcuaaaacgcagcaugagaagaaaccuacaacgauacaagcuacgcagagaugcccugauagaguuauuaaaaaaagucggcuuuauaacagacaaaacaauuuuaucagaacaaggaaauaggacaacuuucgaaacguacagacugagagccaaagcugcagaggaagaaauaaguuuaaaagaauuagcuaggguacuauuaaugaucaacaaaaaaagaggauacaagagcuccagaaaagcaaagggagaagaagaaggcgcauugaucgauggaauggagauagcaaaaaaacuauaugacgaagaucuuacaccaggacaauuaugccuacaauuguuagagucuggaaaaaaauucuuccccgacuucuaucgcagcgaccugcaagaagaauucaacaaaauaugggacuuucaaaaacaauuuaaccuuuucucauuuugcgacguugcaaaagaagaaguaaaaggaaaaaauaaaagucagacaugggcaauacuggccaaauacuucguagaaacaaaaaaaguaaauguauggaacgaacacgaggcucaaacggaaaacagagaagaaguauauaaauuaguuggccuuaagcguacagucaaaggagaagaauugaagaaagaaaauuacagauggcgaguccaggcacucacagaacaauuagaccuugaaaaaauagcuguaguacuccaagaaauaaauggccaaauuucugcuaguucaggguacuuaggagcaauaucugaccgcucaaaaguacuuuacuucaaccggcaaacuguaggccaauaccaaauggccgaacuuaauaaaaaccccaauaugucauuaagaaauaugguauuuuaccgucaagacuauuuagacgaauuuaacguaauuugggaaaaacaagcugaguuucacaaagaacuaacucccgaacuuaaaaaagagauccgagauauaaucauauuuuaucaaaggcgauuaaaaucacaaaagggauuaauaucauucugcgaauuugaaaaccgagaagugguuguggaaaaagaaggaaaaaaacaaacaaaaauaaucgguuguaaagucauaccaagaucacauccccuauuucaggaauuuaaaauauggcaaacguugaauaacauagaagucuucguaggcgaaaaaaagggaaaaaggaaaaagagcaacguaucuucagaccuauucggagauacugaggacgcacuaauaacagaagguaggagguuccuauaucaagaagaaaaaaaaauacuugccaaagaauuaucgaucaaaaaaggacucacaaaagcugaaauacucagacuauuauuugaaaauccacaagaacuugauaucaacuucaaacagaucgacggaaaucaaacuggauuugcauuauucucagcguauucaaauaugauagaaaaauauggauacgaaccacuugacuucaaaaaacccgcagaggaccuaauuucacaacuaaagacaguuuuuacugaucuaggauggaauacagaccuacuauucauugaccuugauaaagagaauaaagaaugggagaaacaaccauacuuucgacuguggcaucuacuauacagcuucgagggcgauaacacaccaacaggcaaugggaaguugauagaaaaaaucaugcaacuaugcgggauagaaaaagaauacgcuauugaguuggccaaugugaguuuacaagaugauuauggcaguuuaagugcaaaagcgaucaaaaaaauauuauuauauuugaaagaaggaaaucaauacgauauggcaugcgaauaugcaggcuacagacacucuaaaucaagccuuacaaaagaagaaauagaaaauaaaguacuaaaagacaaacuagaaauauuacccaaaaacucauugaggaacccuguaguagaaaaaauacugaaccagauggugaacguaauaaacaccguuauggaaguauacggaagaccagacgaaauacgaguagaacuagcgcgggaacugaaaaaaagcgcgaaagaacgagaagaacuaacaaaagcaguugccaagaauacacgcgaacacgaggaaaucagaaaaguuuuacaaagugaguucggaaugauaaacgugucuagaaaugacauaauucgauacaaauuauacgaagagcuaaaagacaacgguuacaagacauuauacaguaaucaauacauucccagagagaaacuauucucgaaagaaauagauauagaacauauaaucccacaaagccgacuauucgaugauucccuuucaaacaagacgcuagaauauaaaagcauaaacauagaaaaaggaaauaaaacagcauacgauuucguaaaagaaaaauacggugaagagggucuacaacaauauuuaaaucgcugugagaaucugugcaaagauaaaaaagccaaauuaagaaaacuaaaaauggaacugaacgagauaccagauggauucauagaccgggaccuacgaaacacacaauauauugccaaaaaagccuuaucaaugcuaacggaaaucugccguagggucguagcgacaaccgguaguauaaccgacaaacuaagagaagauuggcaguugguggauguaaugaaagaauuaaaccuaccgaaauaugaagccuuaggacuuguagaaguauaugaagauaaagacggccgaaaaauaaaacggauaaaagauuggacuaaaaggaacgaucacagacaccacgcaauggaugcacugaccgucgcauuuacuaaagauguauucauacaguauuucaauaacaaaaaugcagcuugggaaagugauagcaaagaacauacuaacauagugggcauuaaaacacgcuauuuugaaagcggaaaagccgucccaccaauaccucuaggacaauucagaguagaagcaaaaugccauuuagaaaaucuucuuguaucaauuaaagcaaagaauaaaguuguuacaacaaacgucaacuguauaaaaaagaaaggagggacauacaagaauacgcagcaaacaccgagaggacaauuacaccuugaaacgauauauggcucacacaaucaauacgugacaaaaauagaaaaaguaaaugccucauuugacgcagucaaaauugcuacagucagcaaacaagauuacagaaaugcccuauugaaaagacuagaagucuuuggcaacgacccaaaaaaagcauucacaggcaaaaacucauuggaaaagaauccuaucuacuuggauagagcacaaacaauucaagucccagauaaaguacagacaguugaauuagaaacugcauauacaauuagaaaaccaguagauccaacacuaaacguagauaaaguuguagauaagaaaaucagacucauauuagaacaaaggcuaaaagaauacgggggagacgcaaaaaaggcauucguuaaccuagaugaaaacccuauuuggcuaaacgaagaaaaaggaauaucaauuaaaaggguuacaauaagaggaauaucaaaagcacaggcacuacacgacaagaaagacaaagaugguaacuucauccuugacgaaacgggcaaacgaauaccuguagauuuuguaaauacaggaaacaaucaccaugucgcaauauacagaaaaccaguucucgacaaaaaaggacaaguaauuuuugaugaugaaggcaacccaauguacgaauuggaugaagauguuguaccuuucuucgaagcaguaaccagggccaaucucgguauaccaaucauugauaaagacuacaaaaagagcgaaggcuggcaguucuuguucuccaugaaacagaacgaauacuuuguauucccuaaugaaaaaaccggauuuaacccaaaagaaguagauuuauuagaccccgacaacuacgcaaugauaucaccaaacuuauucagaguacaaaaaauaggauuaaaugauuacaccuucagacaucauuuggaaacaacgauacaaaaugaccucaaguuuauaaccuggauucgauguggcaaaagcggcauaaaagauauaguaaaaguuaggauaaaucacauaggacaaauagucucaguaggagaauauuga

SEQ ID NO: 9174 - RNA, 4332 nt, Artificial Sequence
  Cas9 variant
augaagaaaauacuaggacuagaccuuggaacagcuuccaucggaagugcauauguacucgaagcagaaaaaucagcugaccaaacuaaaauaguauauuuaggaacacgaaucauucuaagcucugcagaugcagaaaauuucuccaaaggucuaaguuguucacccacaacagauagaacauucaaaagaucuaugagacguagauuacaaagauauaaacaacggcgaaguucgcuuauacaacaauucaagaaaaucggaauaauaacuaauacagaacaaauuauaagggaaccaaucucugaaacccaugaacuucuacgaauuagaucgaaagcagucagcgaacacgucucucuagaagaauuugcaagaauauuacuuaccauaaacaaacgaagaggauacaaaucuaacaggaaaacaucaaaauccacagaagaagauggcaaacucguagacgcaauggcuguuacuaaagaacucauaaaacuaaagaaaacaccuggacaauauauguucgaacgauucaaacguggaaaauaugccgaaauagauuucuaucccuucgaccuaauaaacgaacuaaaacaaauuugggaaguacaaggucaaaaauauccagacguacuaaccgaaggacuacuaucaucacuucuuaaacagaaaacaggaaaagcaaaagaauuaaucuacuccaaaagugauuuaaacccugccgaaguacccauagacuaucaaaaaggaaagaaauuaaggaaaacaauccugaacaaauauuucgcuuaugaaucccgaucgcuagcaguuaccaacauaauaccaguugaacaagcaauaacugccauuguagcuauauguaaacagauaaacaacagcucaggauaucuuggugcaaucggagauaggagccgaguacucuaugcgaacaaccaaacaauaggucaauaccuauacgaacgaauuaaagccaacccacacgacagaauaaggggcgaagucuucuauagacaagacuauuuggaugaguucgauagaauaugggaaugccaacaaaauuauuacccagcaauauuaacaaacgaucgaaaacaauauauacguaauagaauuauauuuuaucaaagaccguuaaaauccaagaaauccgaacuagcauuuugugaguucgaaagucgagaaguagaacacaacggaaagaaauauacagaaggacuacauguagcacccaaaucaucaccaguauuucaacacuuuagauuguggcaacgccuagggcagauagaaguaaguccacucagaaaaugggacaaacaaucaaaugagcuauuugaacaacaaaauaacgcggaccgugagggcauccuaaacacugaggccaaacaaaaacuuuuuagcuaccucaaccuuuuagaccacuuaacagacaaugaaauacucaacauauugggguauucaccugacaaauggaaaauaaauuucagagaaauaauaggaaaucgcaccaauaauuuaaugaugaaagccuuuuucucaaugaaagaaaugacugacggagaacagaucgauugggagaaaaaucucaccaaaauuacuaacggccaaucuuugaucagccccgaacaaauuguagaucuuauaagacaguuuuucgaacgcgaaggaaucacaacuucucuucuguauuucgacccagcaacggacaauuuuagggaacaaucucacuacucccucuggcaccuccuauauaguuacgaagaugauaacagccccacaggaacaacaucucucugcaaaacgcuggccaagagauauggaauaccacacgaacuuugcccauuauuagcuucauuaacauucgagagacaauauggaucacuaagcacuaaagcaaugcguaaauuacuaccauucaugcaagagaaaagauacgaugaagcgugcgaacuggccgguuauagacacucagcauggauaacuaaagaagaaaacgcaaaaaggacucucaaaaacaagcuaccucuacuaaggaaaggaagccuacggaacccaguaguagagaaaauacugaaucaaaugacacacguuaucaauacgcacauugcugaauauggcaauccagacgaaauaagaauugaaauggcccgcgacaugcaagcuaauucaaaacaacguaaagcgaugacagcagcaauaaccgaagccacuaaaaggaauacccaauuuauugaagaaauccaaaaagaauuuggauuuaauccaaguaaaaaugaccuaauuaaauacaaacucuggaaagaguuagcaccauuaggaaacaagaccuuauacagcaacauauauauccccaaagaggaacuauuuacagcaaaauuugaaauugaacauauaauacccagagccuuguucuaugaugauagcuucaguaacaaaacucuugaacuuaauuccgucaauaaacucaaaggaaauaaaacagcacuggacuauuuagacacguugggacaagaaaaagcaaacgauuauauauuaagaguggaagaacuaaagaaaaucggagcaaucacucaagccaaauacaagaaacuuuuaauuagagaaaaagaucuaggugacgacuuuacuaaucgcgaucuaacaaauacuagauauauaaucagacacgcugcagauagagaccuaacaaauacaagauauauaauacgccacgccgccgacauguuacuacaaguaacaccgaguauagugcacacaaaugguucuaucacagcaauauuaagaagagauuggggccuacuagauauauugaaagaauuaaaccuaccaacguaugaaucaauagauaggaaaauaagugacccagaagaaaaacucacacaaucaguagaccguaaagauggucaagcgauaaaaaugauaaaagacuggucaaaaagagacgaucacagacaucacgccauggaugcauuaauuacugcgcucacaaccagaaaacauguacaauaucuaaacggaaauuccggagcagaagaaacagacaaagcacaaaaacuagaacaauuaaaagcgcuuagaaaacaauuaauagguuccgacggccacuucauacccccaaugcacgauauaaggguacaagcaaaagaagcacuaucaagagucauuauaucaacaaaaguaaaaggaaaaguaacaacaccaaauacuaacauuaucugcaguagagauaaaacuacagguagaaaaauauacgucaggcaaacuacgcuaacaccucgcggagcauuacaccuagauacgaaauaugggauaaacagguacuaucaggaacgagaaguaucaauaggaagcaaacuaacucaagaagaaauaagacuuguaucuagcccacacauacaaagcauauuauuagaaagauuaagagcauucgacaacaaccccaaaagugcauuuacgggucgcaacucagucgauaagaaaccauuagaagacaaaaauaagaaauuaguauacacugauaagaaaguaaaacaaacaauauuagcgaacagauucguuaaaagagacagaguuaacuccaaauuagaccuagacaacguaauagauacagguauaaaaagaauacuagaaagacgccuaaaacaguauggaggaaaauaugaaacugccuucagugaccuagaaaauaacccuauauggcuaaaugaggaaaaaggaauugcaauaaaaagcguucggauuagagguaaaaacaacacaauaacuauaagacaaaccaacacaugccgcauaaaauauguagcgaacgauaauaaucaucaccuugcaguuuaugcccuaccagauggaagcaucaaagaugauauaguuagcuucuuugacgccguagaaagauccagaaaaagacuaccaauaauagacaaacauaaaaaucagucucuagguuggaaauaccuauuuagcaucaaacaaaaugaguacuuuuuacuaccacagcaaguagagaaaauagacauagauacaggagaaauaucaaugcaaacaacguucagccccaaagaucucucucacgaauacaucaugaauccagauaacuacgcagaacuugccagucauauauuccgaguacaaagcaucaguaaaacaccacagggaaaucgcgacguuaggauauauuuauuuaaacaacaauacauuaguggaucacaaaaagacagcuuacauuuaaaaggaauaacacaccgacaaauuucguccgcaaaagauuuagcugagcuaguaaaaauuagagucaaccaucugggcagaauuguaucagucggugaaaaauga

SEQ ID NO: 9175 - RNA, 4341 nt, Artificial Sequence
  Cas9 variant
auggugaaaaacauuuuaggucuagaucuuggaacuaacucaguuggaugggcuuuaaucaaacaagacuuugaaaacaaacaaggugacauacuuggaaugggcucacgcauuauacccaugucacaagacguguuaggagauuucggaaaagguaacucuauaagccaaacagcugaaagaacgaaauacaggucaguaaggcgcuuaagagagagauuucuacuucguagagaacgccuacaucgcgugcuaaauguacuagauuuccugcccgaacacuacgcuucgcaaauagacuucaauaaaagauuuggaaaguucaaagaagaaacagaaccaaagcuagcauauaguaaugauggauuuauauucaagaaauccuucgaagaaaugaucucggacuuuaaaacacaccaaccugaauuauuagagaauaauaagaaaguuccauaugauuggacuauauauuaccuaagaaacaaagcucuaagucacaaaauagaaaaagaggaacuagcauggauacuucucaacuucaaucaaaaacgagguuacuaucaacucagaggagaagaagaagaagaaaaccccaacaaacucauagaauuuuacaguuuaaaaaucguagauguauuagcugaugaaccucaaaaaggaaaaagugacauaugguauagucucauacucgaaaacggcuggaucuacagaagaagcucuaaaauaccucuacuggacuggaaagguaaaacucgagacuuuauugucacuacagaucuaaacgaugauggaucggucaaaaccgauaaagaaggcaaugagaaaagguccuuccgagcgccaggcgaaaacgauuggacacuuguuaagaagaaaacggaacaagaaauagauaacucagacaaaacuguaggagcauauauuuacgaagcccuacuacaaaaucccaaacagaaaaucaaaggaaaauuaguucguacaauugaaaggaaauuuuacaaggcugaacuaaaacaaauacucgagaaacaaauggaguuccacccagaacuuagacaagaugaucuuuacucugacugcguaagagaauuauacaaaaauaaugaagcgcaccaacuaacguugucaaagaaagacuuuguacaccuuuucauggaagacauaaucuuuuaccaacgaccauuacggucacagaaaagcucaauuucaaauugcacacucgaauuuagaaaauauaaagaugaaaauggcaccgaacauauucaauaccuuaaagcacuaccaaaaucgaauccauauuaucaagaauuuaggaucuggcaauggauguacaaccugaacauauacaagaaagaagacgacacuaacguaacaaaagaguuccuaaauucuaaagcugacuucgaaucuuuauucgaauuucucaauaacaagaaagaaguagaucaaaaagcauuacuaaaacauuucaaaauaaacgauaaaacgcaucgauggaaauacgucgaagacaagaaauaucccugcaacgaaacgaaaacaaugauaucagaacguuuaaagaaagucgaaaacaucagugaugacuucuuaacuagagaaauggaacagaaaauauggcacauaauauauagcguaaacgacaaagucaaauaugaaaaagcauuaaaaucauucgcugagaaaaauaacuuagaugaaagcucauuuuucgaagccuucaagaaauucccacccuuuaaaucagaauauggagccuuuagcgaaaaagcaauaaagaaacuauuacccuuaaugagacugggaaaauacugggaugaugacgagaucuuaaaauauagugacauuuauuucaaaaacauagaauaucuacucggaguauuaaaacaaaaagacaaaaacauaucagacgacaaccggcaaaacuggaacaaaucuauuaauaacaaacuaagggaggaacuagaaauauuucaaaacgcagaaaucgaauccuuucaagggcucagguuacauauagcacaauacauuuuguauggacgacacucagaagcagcaauguuaggaaaauggaacagugcagacgaccuagaagaguuccuaaaagaguucaaacaacauagccugcgaaaucccauaguagaacaaguaauaacugaaacguugagaguuguaaaggauaucuggguaaaauauggcaauggcgcaaaagauuucuucaaugaaauucauaucgaacuuggccgggaaaugaaacuacccgcagaagacagaaagaaaauuacaaaucagauaucugaaaaugaaaauacaaaccuaaggauaaaagcccuacuagcagaaaugauggucgacucgucaguagaaaaugugcgaccuuuuucaccaaugcaacaagaaauccugaaaauauacgaagauggagucuuaaauagugacauagaaauagaggaugauauacugaaaauaucuaaaacugcacaaccaucaccuuccgaucucaaacgauacaaacuauggcuugaacaaaaauacaaaagcccauacaccggacaaauuauaccacuuaauaaauuauuuacacccgaauaugaaauagaacacauaauaccacaaaguagauauuuugacgauagcuucaguaauaaaguaauaugcgaagccgcugugaacaaacuuaaagauaauuucaucggauuggguuucaucaaacaauuugguggaacaauaguagaaugcggaaauggcaaaucaguaacgguacucaaagaagaucaauacgaagacuuuguuaagaaacacuaugccaauaaccgauccaagcgaaacaaacuauuauuagaagacauucccgagaaaaugauagaaagacaaaugaacgacacaagauauauaucaaaauacauaucaggaguacuuagcaacauaguacgaacugaagacggaaccgacgaugggguuaacucuaaaaacauaguaccugguaacggcaaaauaacuaacacgcuuaaacaagacuggggauuaaaugauauauggaacgaccuaauacuaccaagauucgaaagaaugaaccaguugaccaacucaacugauuuuaccgcauggaaugaaaaucaucaaaaauuucuuccaacagucccaguugaauuuucgaaaggauuuuccaaaaagagaauagaucaccgacaucaugcucuagacgcucucgucauugcaugcgccacaaaagaucaugucaauuugcuaaauaaucaaucugccaagagugacacuaagagacaugacuuaaagagaaaacucaugaaauuugaaaagguagccuauaaucauccucaaacaggcgaaagaaucgaaagagaaguaccaaaacaauuucucaaacccugggaaacuuuuacaguugaagcuaaaaauggauuggaaacuauuauaguuuccuucaaacaaaauuuaagaguaauaaauaaagcaacuaaccacuaugaaaaauauguagaaaaagauggcgcaaaaguaaaaggcagaguagaacaagccgggacgaauugggcaauucgaaaaccuaugcauaaagaaacugucucaggaaaaauagaucucccacgaauuaagguuccaaaaggcaaaauacuaacugccacccgcaaaaaucuagacacuucauucgaccuaaaaacaauugguucuauaacugacacaggcauucagaaaauucucaaaaauuaccuucaauacaaagacaauaacccagaacuagcauucuccccagaaggaaucgaagacaugaacaaaaauauugaaaaauuuaacgacggaaaaguacaccaacccaucauaaaaguaagaaucuuugaacuaggaaguaaguuucccuuaggccagucaggaaauaagaaagacaaauacguugaagcagccaaaggaacaaacuuauucuucgccguauacgaagauaaaaauggaaaacgaucguaugaaaccauaccucuuaacgaaguaauagaacgacaaaaacaaggccuaaccguaguagacuuaaaagguguaaaugauuucuauuuauccccaaacgaucuaguuuacguaccaucugaagaugagcuugagaacgugaguaugauagacuacaauaaguuaaguaacgaaaaagucuacaaaguagucaguuuuacuggaaaccaaauauucuuugucagacaagacguagcgacauccauaguaaauaaagcugaguuuagcucauuaaacaaaauggaaagagcaauaggaggaacuaugauaaaagaaguauucguuaaaaucaaaaucgaucgacuagguaacaucucgaaaguauga

SEQ ID NO: 9176 - RNA, 4347 nt, Artificial Sequence
  Cas9 variant
augaaacauauacucggacuugaucucggcacaaacucaauaggcugggcaguaguaaaggaagcacaaaacgauaaugaacaaucagaaauagucgacguaggaguaaggguaaauccacuuaccaccgacgagaaaacuaacuuugaaaaaggcaaaccaauaucgaccaaugcagacagaacccucaaaaggagugcccgaagaaacuuacagagauauaaacuaagacggaaagaacuuauagaauuauuaaaagaacaucaacuuauaagugaaaauacaauacucacagaaaacgguaaaggcaccacauuccaaacucuagaacugcgggccaagucugcgaaagagaaaauauccuugggugaauuagcaagagucuuuuuaaccauaaauaagaaaagggguuauaaaaguagucggaaagcgaaaaacggagaugaaggacagcugauagauggaauggaaauagccaaacgucuauacgaagaaaauuugaccacaggacaacuaucacuacaacugcucaaggagggaaagaaaucacuccccgacuacuacagaucugauuuacaguuugaacuagacaaagucuggaacuuccagaaacaaucacacagugacauacucacugaugaguucuaugcccaacucaaaggaaaaggacagcgcgcaacuucagcccucuuuuuggccaaauaccagauauacacugcugaaaauaaaggaagcagagaagauaagaaacuacaagcauaccaauggaggguugaugcacuaucaaaagaacuaacuagagaagaacuggcauucgucauaacugaaauaaacaauaaucucaauaacaguucaggauacuuaggggcaauaucagacagaucaaaagaacuauacuucaauaacgagacagucggggaauacuuauggaaacaaauagcagcgaauccacacaauucucuaaagaaucaaguauuuuaucgacaagacuaccuagacgaguucgaacaaauauggaaaacacaaagugcauucuauccagaaauccuaacagacgaacuuaagaaagaacuaagagauguaguuauauuuuaccaaagaaaauugaaaagccaaaaaucucuugucuccuucugcgaguucgaaaacaaagaaauagaaauuaaaaaugaagauggaacuacaacuaagaaagugauaggucuuaaaguagcccccaaaaguaguccucucuuccaagaauuuaaaauuuggcagaaucuaaauaauguacuaauucgaaagaaaggaagcaaaacaaagaaaguagcgaaaaaucagcaagcaguucuauuugaagaagagaaaacuauaucagaacuugauuuagaggcuaaacaagccuuauucaacgaacuaaaccuaaaaggaaaucuaaaagcagacuacugucucgaaauccucggauacucaccaaaagaaugggaaaugaauuauucaauucuggagggcaaccgcaccaauaaagccuuauacgaggcauaccuaaaaauaacugaucucgaaggauacgacgcuaaaaaccaucuaaaaguaaaauuaaauaaagacgaaguugaacucgaugaucuuaagguaccagccucagaaaucaaagauaugguccaggcaauuuuuaaagaagcaggaauuaauacagauauucuacacuucaacgcagagcuugacggaaaagacuucgaaaaccaagcaucuuaccagcuauggcacuuacuauauucuuaugaaggagacgauucuaaaucaggaaacgagcuauuauacaaacugcuggaaacaaaguuuggguuuaagaaggaauacgcacaaauacuagcaaauguaucccuaagcgacgacuacggaaaucugaguacaaaagcuaugcgcgaaauuauuacacaucuaaagcagggauuccccuucacaggaagaaaagacagaccagaugaaccaucagcaugcgaguucgcaggauauaaacacucaaaacauagcuuaacaaaagaagaaaacgaaaaacgaguuuuaaaagacagcuuagaagugcuaaagaaaaacagcuuaagacagccaguuguagagaaaauauuaaaucaaaugauaaaccuuguaaaugcccuacuuaaaaaguauagaacagaaaaucccaauuuuaaauucgacgaaauuagaauagaguuggcgcgcgaacuuaaaaagaaagcugaagaacgagcaaauaugacagcuaacauaaacaaagcaaaaacagaacacgaaaagauaauaaaaaucuugaaaaacgaauuuggcuuacccaacccuacaagaaacgacaucauaagauauagacucuaugaagaauugaaagauaauggauauaaagaccuauacaaaggagacuauauaccaagagaaaaacuuuucucaaaggaaaucgauaucgaacauauaaucccaaaagcacgaguguuugaugauagcuucagcaauaaaacgaucacauaucgaaaaacuaaccuagaaaaaggagaaagaacagccuaugauuacaucgaaucccucggggaaaaacaacuggaagaguuucuaaguagaauagaaaaccuauaugaaauaggaaaaccaucgcgcuuacacaauagaagaaacccucuaaagaaaguugaagagaaagggauaagcgacucuaaauauaagaaauuacucaagaaagagagugaaauaggagauggauuuguagaaagggaccuaagagaaacacaguacauugcaaagaaagcuaaagaaauacuacugcaaaucacaagaucaguuuuaagcaccucagguggcauaacugaucgauuacgagaagacugggaucuaauaaauguaaugaaagaauuaaaccuacccaaauacagagcacuaggccucacaaaaauggaagauagaaaauauggccaacaaguagaaguaauaacagauuggacaaaaagaaacgaccuucgccaucacgcaauggaugcacucaccguugcauucaccaaacacaaucauauacaauaucuaaauuaccuaaacgcacguaaaaaugaaaagcauaaagaacacaacaacaucauggcgauucaacaacuagagacuauuaaaguaacagacgagaaugggaacgaaaaacgaauauucaaagcaccgaugccuaauuuuagacaaguggcaaaagccuuucuagaaaaugucuuaauaagccauaaagccaaaaacaaagucguaacgaaaaacaaaaauaaaauaucaggcaacaacaaaguacaagaaguacuaacaccaagaggacaacuacacaaagaaacaauauauggaaaauaucaauauuauguucaaaaagaggagaaaauaggaggcaaauuugauuuagaaaccauugaaaaagucgcaaacccgcuauaucaaucauuauuaaagaaaagacuagaagaaaacggaggagaucccaaaaaggcauucacagguaaaaacaguuuagccaaaaacccaauauaucuagaugaagcacaaacagaacaauuaccagaaaaagugaagcuaguauggcuagaaaauucuuuuucuaucagaaaagauauaacacccgaaaauuuuaaagacgaaaaacugaucgauaagauacuagacgagggaguaaaacguauccuaaaagaacgccuucaaaguuuuggaaacgaugcaaagaaagcguuuucagaucuagaaaagaacccaauaugguugaacaaagagaagggaauugcgaucaagcggguaacaauaagcggaguugcaaacgcugaaccacuacauaccaagaaagaucauuuaggaaaagaaauacuugacaaagagggaaaaccuauaccuguagacuuuaucucaacaggcucuaaccaccacguagccguuuaccgugaugagaaagguaacuuacaagaaaaaguaguaagcguauucgaagcagucguaagagcuaaccagggucuaccaauaauugacaagacguacaaucaauaccuuggaugggaauuucuuuucucgaugaaacaaaaugaaauguucguguucccaaaugaaucaacuggauuuaaccccaacgacauagacuugcuagacccgaaaaauaaaaagauaaucagcccaaaucuauucagaguacaaaaauuagcaacaggagauuacugguucagacaucacuuagaaacaacuguagaaacaaaaucugcuacgaaagauaugacauacaaacgucuuucguuaaaucacauaaagaacauaauaaaaguuagaauaaaucauuuaggugacauaguauccguaggugaauauuga

SEQ ID NO: 9177 - RNA, 4353 nt, Artificial Sequence
  Cas9 variant
augaaacauauacuuggacucgauuuaggaagcaacaguauuggaugggcauucguccaacaagauuucgagaauaaacaaggcaaaauaauugcaacaggaaguagaauuauuccuauggaucaagguauacucggagauuuugaaagagguaacacuguaagucagacugccgaaagaaccacauauagaaacacaagacgacuaagggaaaggcauuuauuaagaagagaaagacuacacagaguucuacauauccucggguuccuaccgccacauuacgauucacaaaucgacuucaccaaacgauacggaaaauuuauagacaacgcagaaccaaaaauagcguacaauaacgguaacuuuauauucaugaauucauuuaacgaaaugauugaagacuucaaaaaauaucaaccucaauuauucuacaaaaagucaaacggagaagagucaaaaauuccauacgauuggacaauuuauuaccuucgaaaaaaggcuuuaagccagaaaauaacucaacaagaauuagcauggcuuauauuacacuuuaaucaaaagagagguuacuaucaacucagaggagaagaagaaacagaaaaccccaacaaagagguagcuuuucacuccuuagaagucguggauguagaagcugaagcacccaauaagaaaggcgagaucugguauacgauaagacuagagaacggauggauauaccgacgaacaucuaagauacccuuagacgacuggaaaggaaaaacacgcgacuucauugucacaacagaccuaaaugacgacggcacaaucaaacucgacaaagaaggcaaagaaaaaagaaguuuucgcgcuccagaugaaaaugauuggaaucucuuaaaaaaaaaaacagaacaugacauugauuuuuccggcaaaacaguaggcgcuuauauauacgaccaucuauuacaaaaucccaaccaaaaaaucaaagguaaauuaguucgaacuauagagagaaaauauuacaaggacgaauugaaagcaauacuugcuaaacaaauagcucuacaacccgaacuauucacggaaacacuauuagccgauuguauaagagaacuauauagaaaaaacgaaacacaacagcagaacuuacuaagcaaggauuuccuccauuuguuuguugaagauaucaucuucuaucaaaggcccuuaagauccaaaaaaucaacaauugcaaacuguacacuagaaaagagauccuauauagauaaagaaacaaaugaaagaaaagauacacccauaaaagucugugcuaaaucaaacccguauuaucaagaauuccgugugcuucaguggcuucaaaacuugagaaucuacgaaauugaaacggaccgcgaaguaaccgcugaauucaucgaaacagcacaagauaacgaagcauuauuuaauuucuuaaugucacaaaaagaaauugauaaugaaucauuauuaaaauacuuucuauucgcaaaaaacccacaaauaaaagacaagguagcaaaaucagaacucaagaaguggcuaaccacguaucguuggaacuaugucuacgacgccgccgauaacaguaguaaaaaauacccgaugaacgaaacuggcuaugaacuacaacaauaccuacagaaaguagaaggacuacccgcuaauuuuuuaacuuucgacauaacauauagauuauggcaucuauuauauucagucaaagauaaaguagaauuugaaaaagcacuaaagaaauuugcccaggaauaucaacuagacgaagcuagcuuugucgacucuuuuaagaauuucaaacccuacccaaaugaguaugguucauucagcgaaaaggcaaucaaaaaacuacucccucuuaugcguuucgguaaccauugggauuuuaauagaaucgauguuucaacacaaaagagaauugacgaccuaaucaacggaguagccaacgacgaaauaagaacaauuauccgcgaaaaggccgaaaaguaccagcugaacagugaaacauguuuucaaggacuaccauuguggcuugcacaauacgucguauauaaccgacacgcagaggccgcagauauagagaaauggacaucagucaacgaucuagaagcauauuuagaagacuucaaacaacacucauugcgaaauccgauaguagaacaaguaauuaccgaaacacuacguguaguacgagacauauggcaaagauauggagguggacaagcuaauuucuuugacgaaauacacauugaauuaggccgcgaauuaaaaaaaaccgcagaagaaagaaaacaauuaucaaacaggaaccaagaaaacgaaaauacaaaccugagaauaaaaaagcuacuggcagaacuuaaagaagacgcuaguauccaaaauguaaggccuuauucacccguccaacaagaauuacuuaaaauauaugaagaaggcguauuuucugcuaccgaugaagucgaggaagauauacaaaaaauacgaaaaaaggccgaaccaacaaccccagaaauucaacguuacaaacuauggcuagaacaaaaauacaagucuccauacacuggagaagugauaagccuuaccaaacuauuuacagaagaguaugaaauugaacacauuauaccucaaaguagauauuacgacgauucauuaucaaacaaaguaauaugugagucagcgguaaacaaauugaaaacgaaucaacuaggccuugaauuuauacagaaucaccacggggaaaaaguacgaaucacagcaaacaaagaaguaacuauauuuacugaagaacaauauaaagaguucguaaaaaaacauuacgcaaacaauagcgcgaaacaacaaaaacuucuacuaaacgaaauaccagaaaaaaugguagcaagacaacuaaacgauacaagauacaucucaaaauacauaucggaaauccuguccaaaauuguacgcucggaugagaaagaugagggcguaaacaguaaaaacauaauaccaugcacaggaaagauaacaaccgcauuaaaacaagauugggguuugaacgaugucuggaaugaacucauauuaccacguuucgaaagaaugaaucaacuaacucaaacccaacuauucaccagcuacaaugaccgauuccaaaaaaacuuacccaccguaccaauagaauauucgcaaggcuuucaaaaaaaaagaauagaccauaggcaucacgccauggaugcucuaguuauagcuugcgccacucgagagcacauaaauuauaugaauaaucaacacgcacuagacaaaaguaaagacaaaaaagaaaaacaacaaucacgcauagaucugcgaacaauacugugcgaaaaaaaaaacaauaacuggcaauucaaaaaacccuggagcacauuuacccaggaagcacaagaagcuuuagaacauaucguuguaucauuuaaacaaaaccugagggucauaaacaaagccacaaacuacuacgaaaaaugggaagaaaaaaauggaguuuuaguaaaaaaaaaaguuaaacaagagggaacaaauugggcaauacgaaaaccacugcauaaagaaaccguuucgggaaaaauaguuuuagaccguaaaaucgguaaagacaaaauucucacagcaaccagaaaaucaguugauauaacuuucacugaaaagauaauaucaaguauaacagacacaggaauccagaaaauauuauuaaauuaccuaaaguacaagggaagucccgaaguugcauucucugcagaaggacuugaagaacuaaacaaaaacaucgcacaauauaacgauggcaaaaaacaccaaccuauauauaaaguaaggauuuucgaagaggggucaaaauucccacuuggagaaaccggagcaaaagcaacuaaauacguggaagcugcuaaagguacaaaccuauuuuucggcgucuaccaaggaaaagguaaaagaacuuaugccaccauuccccuaaacgaaguaaucgaacgucaaaagcaaggauuaccauccguuccagagagaaaugaaaaaggagaaccauuacuauucagucuuucgccaaacgaucuaguauacguacccauggagggagaaauagcagagacuauagacuuuaacaaccucucuaaagaacaaaaagaacggauauacaaaaccguuucauucaccggcaaccaaugcuuuuucguccaagaagccgucgcaacccccauaguuaacaaaauagaauacucaccacucaauaaaauggagcgagauaucuuaggcacaaugauaaaagaaguauguauaaaacuaaagguagauagauuaggaaauauaacaaaagcauga

SEQ ID NO: 9178 - RNA, 4353 nt, Artificial Sequence
  Cas9 variant
augaaaaggauacuuggacuugaucugggcagcaacagcauaggaugggcuuuuguagaacaagacuucgaaaacaaacaagguaaaaucaucgccacagggagcagaauaauaccgauggaucaagguauccugggagacuucgaaaaaggcaacacaguaagucaaacagccgaaagaaccacguauagaagcaugagaagacuucgugaacgacauuuguugagaagagaaagauuacaccgcguauuacacauccuuggguuccucccuccacacuaugacgcccaaauagauuuuacuaaaagauacgguaaauuuauagauaaugcagaaccaaaaauagcauacaauaauggaaauuucaucuucaugaacucauuuaaugaaaugauugaagacuuuaagaaauaccaaccucaauuauucuauaagaaaucuaauggagaagaaucaaaaauacccuaugauuggacaauauauuauuuaaggaagaaaguacugucacagaaaauuacccaacaagaauuagcuuggcuaauacuucacuuuaaucagaaaagaggauacuaccaacuaaggggagaagaagaaacagaaaauccaaauaaagaagucgcauuccacagcuuaaaaguaguagacguagaagcggaagcucccaauaagaaaggcgaaauaugguacaccauacgcuuggaaaauggauggauauacagaaggaccagcaaaauaccacucgacgauuggaaaggaaaaacucgagauuucauagucacuacagaccucaacgacgauggaacaauaaaaguagauaaagaaggcaaagagaaaagaucauuucgagcuccugaugaaaacgauuggaaccuucuaaagaagaaaacggaacaugacaucgacuuuuccggcaaaacuguaggcgccuauaucuaugaucaucuacuacaaaaccccaaccagaaaauaaaaggaaaacucguaaggacaauagaacgaaaauacuacaaagacgaacuaaaagcaauacucgcuaaacaaauagcacuucaaccagaacuuuucacagaaacacuauuagcagacuguaucagggaauuguauagaaagaacgaaacccaacaacaaaaucuccuuucuaaagauuuccuacaccuuuucguugaagauauaauauucuaccaaagaccccuuagaucaaagaaaucaacaauagcgaauuguacacuagaaaaacguagcuacauagauaaagaaacgaaugaacgaaaagacacauucaucaaaguaugcgccaaauccaauccauauuaucaagaauuucgaguucuacaauggcuacaaaaccuucgaauauacgaaauagaaacagauagggaagucaccgcagaauuuauagaaacagcagaagacuacgaagcucuauuuaacuuccuuaugucacaaaaagaaauagacaaugaaggacuacucaaauacuucuuguucgcgaaaaacccccaaauaaaagauaaaguugcaaaaagugagcuuaagaaauggcuaaccacauaccgauggaacuauguuuaugacgcagcagacaauucauccaagaaauacccaaugaacgaaacaggauacgaccuacaaagauaucuacaaaaaguugaaggccuaccagcaaacuuuuuaacuuucgauauaacauauagacuauggcauuuauuauauucaguuaaagacaaagucgaguucgaaaaggcuuuaaagaaauuugcacaagaauaccaacucgacgaagcuagcuuuguagacucauucaaaaauuucaaaccuuauccaaaugaauacgguucauucuccgaaaaagcaauaaagaaacuucuaccgcuaaugagauucggaaaccacugggacuucaacagaauagauguaaguacacagaaaaggaucgaugauuuaaucaacggcgucgccaaugaugagauaagaacuauuauacgcgaaaaagcagaaaaauaucaacuuaacucagaaaguuguuuccaaggacuuccauuaugguuagcacaauauguuguauauaacagacacgcagaagcgaccgacauagaaaaauggacaaguguaucggacuuagaaacuuaccuagaagacuuuaaacaacauucgcugcguaacccgauuguggaacaaguaguaacagaaacacuuagggugguucgugacauauggcaacaguacgguggaggucaagcaaacuuuuucgaugaaauccauauagaauuaggccgagaacuaaagaaaacagcagaagagagaaaacaacuaagcaacaggaaccaagaaaaugaaaauacuaaccuacgcaucaagaaauuacucgcugaacuaaaagaagacgcaaguauccaaaacguccgacccuacucuccaguacaacaagaacucuuaaaaauuuacgaagaagguguauuuucgucaacagaccagguagaagaagauauacagaaaauaagaaagaaagcagaaccuaccaccccagagauacaacguuauaaauuauggcucgaacaaaaauauaaaagcccuuacacaggagagguuauuaguuugacuaaauuauuuacagaagaauaugaaauagaacauaucauaccgcaaucacgauauuacgacgacagucuuucaaacaaagugauaugugaaucagcaguaaacaaacuaaaaacgaaccaacucgguuuagaguucauacaaaaccaucauggagaaaaagugcgcauuacagggaauaaagaagucacaauauuuaccgaagaacaauauaaagaguucgugaagaaacauuaugcaaauaauucagcuaaacagcaaaaauuacucuuaaaugagauaccagagaaaaugguagcgagacaacuaaacgacacucguuacauaucaaaauacaucagcgaaauacuaagcaaaauuguuagaagcgaugaaaaagaugaaggaguuaacagcaaaaauguaauucccugcacuggcaaaauaacaacagcauuaaaacaagauuggggacuaaaugacguauggaaugagcuuauucuaccgagauucgaaaggaugaaucaacuuacucaaacgcaacuauucaccagcuauaaugaccgauuccagaaaaaccugccaacgguuccaaucgaauauagucaagguuuccaaaagaaaaggauagaucaucgacaccacgcuauggaugcuuugguaauugcaugugcuacaagagaacacauaaacuacaugaacaaccaacaugccuuagacaaaaauaaagauaagaaagaaaaacagcaaucaagaauagaccugagaacgauccucugugagaagaaaaauaacaacuggcaauuuaagaaaccuuggucgacauucacgcaagaaacaaaagaggcgcuagaacacauaguaguaucauuuaaacaaaaucuccgcguaauaaauaaagcuacuaauuauuacgaaaaaugggaagagaaaaacggcguucuugucaaaaagaaaguaaaacaagaaggaacuaauugggcaaucagaaaaccauuacacaaagaaaccgugagcggaaaaauaguccuagacagaaaaauuggaaaagauaaaauauuaacagcuacuaggaaagaaguggauauaacauuuacagagaaaauaaucuccaguauaacagacaccgggauacagaaaauacuacuaaauuaccuaaauuauaaaggaagucccgaaguagccuucagcgcagaaggauuagaagaacuaaauaaaaacauagcccaauacaaugacgguaagaaacaucaaccaauauauaaaguacguauauuugaggaaggauccaaauuuccacuaggagaaaccggcgcaaaagcuacaaaauucgucgaagcagcaaaagggaccaaucuauucuuuggaguuuaccagggcaaagagaaaagauccuaugcaacaauaccacucaacgaaguaauagaacgacaaaaacaaggacucccaucgguaccagaaagaaaugaaaaaggggaacccuuauuauucucucuuucuccaaaugaucuuguuuaugucccgauggagggagaaauagccgaaacuaucgauuucaauaauuuaagcaaagaacagaaagaacgaauauauaaaacuguaucguucacaggaaaccaaugcuucuuuguacaagaagcaguagccacccccauagugaauaaaauggaauauucaccauuaaauaaaauggaaagagacauauuaggaacaaugauuaaagaaguaugcauuaaacuaaaaguugaccgcuuaggaaauaucacaaaagcauga

SEQ ID NO: 9179 - RNA, 4353 nt, Artificial Sequence
  Cas9 variant
augaaacacauucuugguuuagaucuaggcaguaauaguauaggcugggcuuuuguucaacaagacuuugaaaacaaacagggcaaaauaauagcagccgggaguagaauaauccccauggaccaaaaaauguuaucaaacuucgaagaagguacgacaguuagccagaccgcagaaaggacaacauacagaaguaugagaagacuuagagaaagacaccuuuuacggagagaaagacuccaucguguucuccacauauuagguuuccuuccgccucacuaugaugcacaaauagauuuuacaaaaagauacggaaaauuuaucgacaaugccgaaccaaaaauagcguacaacaauggcaacuucauauuuaugaauucauucaaugaaaugauagaagauuucaaagaacaccaaccacaauuauucuauaaaaaaagcaauggagaagagaguaaaauaccauaugauuggacuauauauuaucuaagaaaaaaagcacuaucucagaaaaucacacaacaagaacuagcaugguuaauacuccacuucaaccaaaaaagaggauauuaucaacuaagaggagaagaagaaacagaaaauccuaacaaagaaguagcauuucacucauuaaaggucgucgacguagaagcggaagccccaaauaagaagggggaaaucugguacaccauuaggcucgaaaacggcuggauauacagaagaacaucaaaaauaccacuagacgacuggaaaggaaaaacacgagacuucauuguuacaacggaucuaaacgaugacgguacaauaaaacucgacaaggaaggaaaagaaaaacgaucuuuucgagcucccgaugaaaaugauuggaaccucuugaaaaaaaagacagagcacgauauagacuucagcggaaaaccagucgguaccuacauauaugaucaccuucuccaaaacccaaaccagaaaaucaaggguaaguuaguacgaacaauagaaagaaaauacuauaaggaugaacuaaaagccauacuagcaaaacaaaucgcacuccaacccgaauuauuuaccgaaacuuuacuugcagauugcauccgcgaacuauaucgaaaaaaugagacacaacaacaaaaucuacucucaaaagacuucuuacauuuauuuguagaagauauaauauucuaccaaagaccauuaaggucaaaaaaaaguacuaucgcaaacugcacccuagaaaaacgaagcuauauagauaaagaaacaaacgaaagaaaagacacaccaaucaaaguaugcucaaaaaguaauccauacuaccaagaauuuagaguguuacaauggcuacaaaaccuacguauauaugagaucgagaccgauagagaaguaaccgccgaguucauagaaaccgcccaagacuacgaagcccuuuucaacuuuuugaugucccaaaaagaaauagacaaugaaucauuacuaaaguauuuuuuauucgcaaagaacccccaaauaaaagauaaaaccgccaaaauagaacuuaaaaaauggauaacaacauacagauggaacuacguauacgauguggccgacaacucuaguaaaaaauacccuaugaaugaaacuggcuacgaccuacaacgauacaugcaaaaagucgaaggccuucccacuaauuuccugaccuuugacacaacuuacagacucuggcaccuacucuauucagucaaagauaaaguagaauucgaaaaagccuuaaagaaauucgcaaaaaaaaaacaacuagauaaaacgucuuucgucgauucauucaaaaacuucaaaccguauccgaacgaauacggcuccuucagcgaaaaggcaauuaaaaaacuauuaccauuaaugagauucgguaaccauugggauuuuaacagaauagauguuagcacccaaaaacggaucgacgacuuaauaaacggaguggccaaugaagauauacgaacaauaauccgagaaaaagccgagaaauaccaacuaaacucagaaacaugcuuccaagacuuaccacuauggcuugcacaauacguaguguacaaucgucacgcggaagccaccgauauugaaaaauggacauccguaagugaucucgaagcuuaccuugaagauuuuaaacaacauucucuacggaauccuauagucgaacaaguuguuacugaaacacucaggguggucagagauauauggcaacaguauggaggaggacaagccaacuuuuuugaugaaauacacauagaacuaggacgagaacucaaaaaaacugcugaagaaagaaaacaacuaagugauaaaaaucaagagaaugaaaauacuaaccuacguauaaagaaauuauuagcugaauuaaaggaagaugccaguauucaaaacgucaggccuuauucccucguacaacaagaacuguugaagauuuacgaagaagggguuuuuuccucaacggacgaaauugaagaagauauccaaaaaauuagaaaaaagguagaaccuaccaccccggaaauacaaagguacaaacuauggcuagaacaaaaguauaaaucaccuuacacaggagaaguuaucucauuaaccaaacucuucacagaagaguaugagauugaacauaucaucccacaaucaagguacuacgacgauagccuaaguaacaaaguuauaugugaaucugccguuaacaaacuuaagacuaaucagcucggucuugaauucauacaaaaccaucacggagagaaaguuagaauaaccgccaauaaagaagucacaaucuucaccgaagaacaauacaaagaauucgucaaaaaacauuacgcaaauaauucagccaagcaacagaaacuccuacugaacgaaauaccagagaagauggucgcccgacagcuuaaugacacccgcuacauaucaaaauacauuucagagauacucucuaaaauaguaagaagugacgaaaaagaugaaggaguaaacucaaaaaauauaaucccaugcacaggcaaaauaacaacugcacuaaaacaagacuggggacuaaacgacguauggaaugaacuaauacuacccagauuugagagaaugaaccaacucacucaaacacaauuauucacuucauauaacgaucgguuacaaaaaaaucuaccaacaguaccaauugaauauagucaggguuuccaaaagaaacgcauagaccauagacaccaugcaauggaugcucugguuauagcuugcgcuacacgagaacauauaaauuauaugaacaaccaacacgcguuagacaaaaguaaagacaaaaaagaaaaacaacaaagccgaauugaucuaaggacuauauuaugugaaaaaaaaaacaacaacuggcaauucaaaaaaccuuggagaacauucacccaagaagcaaaagaagccuuagaacauauaguuguaaguuucaaacaaaacuuaagaguaaucaauaaagcgacaaauuauuaugaaaaaugggaagaaaaaaaugggguacuuguuaaaaaaaaagucaaacaagaagguacaaacugggcaauacguaaaccacugcacgaagaaacuuuuaguggcaaaauaucucugaauagagaaaagguaggaaaaggaaacauauuaacagcgacaaggaaagcaguagacagcucuuucgauguaaaaaaaauaucaaaaauuacugauacgggaauccaaaaaauauuauuaaauuaucuaaaauauaaagggucgccugaaguugccuucagcgcugaaggacucgaggaacuuaacaaaaacauagcacaauauaacaacgggaaaaaacaucaaccgauauauaaaguaagaauauacgaaaaaggcucuggaagguucguauuaggugaaaaaggcaccaaaucaaagaaauauguucaaggagcaccaaaccuauauuuugggguguaucaaggaaaagaaaaacggacauacgcuacuauaccucuuaacgaaguaaucgaacgucaaaaacaaggguuaccaucuguaccagaaagaaaugagaaaggcgaaccauuguuauuuagccuaaguccgaacgacuuaguauacgucccuauggaaggcgaagcaacagaaaccauaaacuuuaauaaccuuaauaaagaacagaaagaaaggaucuacaaaaccguaucauucacaggaaaccaaugcuucuucguacaagaagcagucgcgucacccaucguaaacaaaauggaauacagucccuuaaauaaaauggaaagaaguauuguaggcaucaugauaaaagaaguaugcaucaaacuaaaaguugauaggcuaggcaauauuacgaaagcauga

SEQ ID NO: 9180 - RNA, 4362 nt, Artificial Sequence
  Cas9 variant
augaaaacaguacuuggacuagacuuagguacuaauucaauuggcugggcacuaauacaacaugauuucgacagcaaaaaaggagaaauauuaggaaugggaaguaggaucauaccaaugagccaagauauacuuggcgaauucggaaaaggcaacaguguaucccaaacagcagauagaacgaaauucagaucagcacgaaggcugagagaaagacauuuacuuagaagagaaagauuacaccgagucuuaaacauucuuggauuccuacccagacacuaugccgcagauauagauuuugaaaaaagacugggucaauucuuugaaggcaaagaaccaaagcuagccuacgauaauaaucaauuuauauuuacuaaaucuuuugguaaaaugcuagcagauuucagacaacaccaaccagacuuccugaaggaugaaaaaucuaacgacuugcuaaucccguacgacuggaguaucuauuaccuacguaaagaagcacuaacaaaaaaaauagaaaaagaagaauuagcauggauaauucucaacuuuaaccagaaacgggguuacuaccaacugcgaggcgaagaagaagaagagaauuuaaauaaacucguagaauuucauucacuaaaaaucaucgauguugucgcagaugaaaaauuaaauaacaaaggugaaacaugguacucguuacuacuagaaaacggcuggacauaucgacgaucaucuaaaguaccacuuuucgacuggaaagaaaaaguacgggacuuuauugugacuacagacauaaaugaugacgguuccgucaaaacagacaaagaaggcaaugaaaaaagauccuuucgagcaccaucugacgacgauuggacacuauuaaaaaagaaaaccgaacaggacauagauaaaucgagaaagcccauaggugcauacaucuacgaugcuauccuaaaaaacccaaaacaaaaaaucaauggcaagcucguuagaacaguggaacgaaaauuuuacaaagaagaacugaaacuaauauuacaaaaacaaaaggaauuccacccggaauuacaaucgacagacuuauacaacgaaugcaucagagaauuauacaaaaauaacgaugcacaucaacuacaacuaaauaaaaaagacuucguucaucuauuuuuggaagauauaaucuuuuaccaaagaccccuaagaagccagaaaagcagcgucggaaauuguccacuagaauucaggaaauuuaaagacucagaaggcaucgagaaaguagaauaucucaaaacaaucccuaaaagcaacccauauuuucaagaguuccgcauauggcaauggauguauaacuuaaguaucuauaaaaaagacgaugacgaaaaugugaccagagauuuccucaaaacaaucgaggacugggaggaucuguucgaauuccuaaaccaucgaaaggacaucgaacaagaaacacuauugaaauuucuauugggcaagaauggaguuaagggaaaagcacugaaagucgaagcaggaaaauucagauggaauuacguaucagauaaaauauacccauguaacgaaacgaaggcauuaauaauuucaaaacuagaaaaaguuaaaggcguggaagaaaaauuuuuaaccgaagagauagaauauaagcuauggcacuuaaucuacucaguaaccgauaaaguggaauacgaaaaagcuuuaaaagcauucgcagggaaacaaaaacuagauuuagucucauucguagacucauucaaaagauucccaccauuuaaaaaugaauauggggcuuacuccgagaaagcgauaaaaaaaauacuaccacuauuaagaacagggaaaaguuggaauuggauggcaauagacucaaaaguaagagauagaaucaacaaaauaauaacaggugaauucgacgaagagauuaagaauaaaguucgagaaaaagccgaaaagcauaguuugaaaaaagaaaaugacuuucaaggauuaccacucugguuagcacaauacguagucuacggccgccacagcgaagcaagcuucaguggaaaauggaacaguguagaugacuuaaaaaaguauuuagaagaauuuaaacaacauagucuaagaaauccaauagucgagcaggucuuaacagaaacauuaagggucgucgcagauaucuggcaguucuacgguaaaggagagaaagauuuuuuuagcgagauacacauagaacucggaagagaaaugaaaaacacagcggaagauagaaaagaaaugucagcgauaauacaagcaaacgaaaccacuaaccuacgaaucaaagcacuucuuaaugaacuacuacaggauaaaaagguggaaaauguaaggcccuacagcccaucacaacaggaaauacucaaaauauaugaagauggcguacuaagcucagauauagaaauaccagaugacauacaaaagaucucuaaagcugcacaaccaaccaagucagaacuccaaagauauaaauuaugguuagagcaaaaauauagaucuccauauacaggagcaaugauaccacuagggaagcuauucacaucagaauacgaaaucgagcacauaauaccccaaucacuuuacuucgacgacucuuucucaaauaaaguaaucugcgaaagcgcuguaaauaaacuaaaagacucaagacuuggaauggaauucauaaaagaaugucacgguaugguuguugagacaggcuucggaaaaucaguaacaguauucgaagaagaaacauacagggacuuuguuguacaaaacuauuccaaaaaucacucuaaaaaaaguaaauuauuacuagaagagauaccugaaaaaaugauugaacgucaaaugaaugauacgcgauauauaagcaaguucauaagcucaguccuaagcaacaucguaagggaagaagucaacgacgacgguguaaacagcaagaauaucguacccggaaacggaaagauaacuacccaacuaaaacaagauugggguuuaaaugauauauggaacgaacuaauauugccucgauucgagcgacucaauguacugaccgacaguaaacauuuuacugcaugguccgaaaaccaccaaagacuacuacccacaguaccaauuggacuaucaaaaggauuuucuaaaaaacgaauugaccacagacaucacgcauuagaugcuuuaguaauagcaugcgcaucucgaaaucauaucaauuuuuuaaacaacgcucaugcaauugacaaaaaaaaaaacagugaagaaaaacagaaauucagacaugaccuaaaggccauacuaugcgauaagaaguauucagacaaaucagaaaaaaacuauagauggaucuucaaaaaaccaugggauaauuuuacaauagacaguaaaaaugcucuagacaaaaucauagucucuuucaaacaaaauuuacguauaauaaauaaagcuacuaacagauaugaaaaauggguagaccgagauggaauuaaaguuaaagaauggcauaaacaagaagguauaaacugggcuacacguaaaccauugcacaaggacacggugagugguaagguagaucucaaaagggugacuguuccugaagguaagauauugacagcuaccagaaaaucacucgacaccagcuuugacuuaaaaguuaucgagaguauaacagacacagguauccaaaaaauucuaaaaaacuacuuaacaucuaaaucuaacaauccagaauuagcuuucucauccgaaggaguagaagauaugaacaaaaacauaagaaaauacaaugacggcaaguuacaucaaccaauauauaaagugagaauauucgaacuggguaguaaauuuccuuuaggacaauuuggcaauaaaaaauuuaaguacguagaaacagcaaaggguacuaaucucuuuuucgcuguauacgaagaugaaaacaaaaacaggaauuaugaaacaaucccacuuaauguagugauagaaagacagaaacaaggcuuaaguaguguaccaauuaaaagugagaaaggucacaaauuacuauuuuaucuuagcccuaacgacauuguauauguaccaggaaguaacgaagaauuuuccaucgaccgauuauaccguuuuaccgacucaucugacaaaacugcaaacuuuauuccauuaucagucucaagccugaucuuuucaucaaacaaaaacgaacaaaagaaaauaggaauuucauauccaauacaagaugaauuuggucugggaucgccacaaucaaagaaucaaaaaagcauagauggaauaaugaucaaggagaaauguguaaaagugaacauagacagacuaggaagaguaaguuucuga

SEQ ID NO: 9181 - RNA, 4368 nt, Artificial Sequence
  Cas9 variant
auggcaaaaauauuaggccuugaccuaggaacaaauaguauagguugggcaguuguagaggaucaaaauaacaaaacgacacugaucgacaaaggaguaagaaucuuuagugaaggagugaaaauagaaaaagguaucgaaaaaaguaaagcugcagaacgcacugauuuccgaagugccagaaagauaaaguucagaagaagacuacguaaacaggaaacauuaaaaguccuaauagagaacaauaugugcccuuuaacaaucgaagaauggaccaaguggaagaaagacaaaaaagaauacccaaaaaacccggauuucauuaacugguugaaaaccgacgaauuaaaaaacaucaacccauacuuuuuuagagacaaagccagcagaacggaacuaccacuaaugcaaacaggaagggcacuauaucaccuagcacaaagaagagguuucuugagcaauagacucgaucaaggaucugaugguuuuacagaacagauacgccuugaucugauaaaaaaaauagaaugcgaaacugauaaaacagaacugcucacuagcguucaaucuauaauugacaccuauagcgaagaagaggacaaagacgccaaaaaauuacuaaaaggaguagaaaaacuuuguaaaauaaacaaugaauuaccaauaacggaauuuaaagaaaaacuaauaaauuaccucaacaaggcagacaaccuuggcgcugucaaaaaaggcauagcugacguaaguaaaaaaauaacagaaacugggugcgaaacgcuaggacaauauuucuacaagcuuuaccaaaaucaguccaaaauaagaaaaguguacacagcccgaacagaacacuacuaccaugaguuucuaaagaucugcgaaacccaaaauauaugcgaccaauuaaaacacaaacuagauaaggcaauauuuuaccaacgaccacucaaaucacaaaaaggacuuauagggaaauguguuuuugaaaaaaacaaaacacggugugcaguaagucacccagcauacgaagaauacagagcauuacaauuuauaaauuccauuaaaguaagcgaaacaaaggacggcaaaaaagacuucuuaucguuugacgaaagaaaaaaaauauggccuaaauucauaagaaaaucaaaacccaauuucgacuucaaagagauugcugaaacauuagacaaaaaagguuuaagcagauauuacaacuacacgggucauacgucaguaucgggauguccaacaauagcucaacuaacaaacauauucggagaaaauuggcaagagacacuuuucgaaaaauacacuaacaaacaaaauacgaaaggacuaaaaacuauugaugaaguaguaacagauauauggcauguacucuuuacauuugauaaagacgaaaaaauuauugaauuugguaaacaaaaguuaggacugaacgaaguuuuggcaaaaaaguucggagcaauaaaccuaaaaaaagauuaugcaucauuaucgcucaaagcuauaaacaaaaucuuaccauacuugagagaaggauuaauauauucauaugccguuuuucucgcuaacauagaaaacgucguaggggaagaaaucuggaaaaacgacgaaaacaaaaaccugauuaaaaaagagcuacauuuauugauagacaauuuuaaugaaauaaaaggccucgaagcaguaguaaacgauuucauagcagauuuuaaaaaagaauacaauaaugcucacaaagacuacguacucgaugaacaggacaaaaagauacuacuagaaaaaauagaaucgaacuacggaaagaauaaauucgaaucguuagaaccagacaaaaaaacagagauaauuaacaguacagagaaaaugguagcagaacaacuacgcaaacaaagaggugaauucauaaagccuaagagacuagaugaaaaaauaagugaauucuuaauuaauaacuucaacguaacaaaaaagagcaucgcccgauuauaccacccuucugacguagaaaucuuuaaaacugccagccgcaauucggaaggucuucuacuacuuggaagcccaauagucucaagcauaaaaaauccaauggcuaugagagcgaugcaccaauugcgaaaacuaguaaauacacuuauaaaagaaaauaucaucgaugaagaaacuaaaaucaauauagaauuagcaagggaacugaacgacgcgaauaaacgggcagcaauaaagaaauggcaagaugaaagacaaaaagcucgggaagaauauaagaaauccauaaaggaacucuuuaaagccgaaugugguaaagauauagaaccaagugauagugaaauauuaaaauacgaguuaugggaagaacaacaacacauauguauuuauacaggcaaaacgauuaauauuugcgacuuuaucggagcgaacccaaacuucgacauugaacauacaauacccaaaucuuuauguuucgacaauuccaacgaaaaccuaaccuuaugugacauacaauauaacagagacguuaaaagaaauaaaauaccaacagaacuaagugacuacaauucuauaaaaccuaggcuagauaaaugguuagucuuuauagaugacuacgaaaaauuguauaauacacgaaaaaaagcaaaagguauagaaacuaaagaacaaaaagauaaaaggauaaaggaaaagcacuacuacaaacuccaucuagacuauuggaagggcaaauacaaaagauuuauaaugguagaugucccaucgggauucaaaaauagucaaauuguagauacaggcauaauaacaaaauacgcuauaucauauaugaaaucaaucuucccaaaaguguauagcguaaagggaaauaucguagcugaguuuagaaaaaucuggggacuacaaaaugacuaugaaaaaaaagaaagggucaaucacguccaccacugcauagaugcaauaacuauagccuguaugucaaaacaaaaauaugacaccuuggccaaaaucuaucacgaagaugaagccggcuuccacaaaauuaaaaaagaaacccaguuggugucuaagccguggacaucauucaccauggaugucuuaaacauagaaaaagaaauauucguaagucaucauacacccgauaauaugaaaaaacagagcaaaaaggucguucgcgaaagaggaauaauagcaccaaaaguaaucuacgaaacggaugcaaauaauaacacccuaagggacaaauacggcaaaaaaaucgucaaagaauacauuuuauugaaagauguaaacgguaaccucaucccaaucaaaggaaaacguuuaacgccuucagacauaaucaacaaagucgaugguauugauuauuucagucugauaauaaacgauaaaauacaguauuaugaguucgcaaaauccaaaaaaacaggaaagauaaucuacaaaaaagaaccaauauauuuacaaggugauaccguaagaggaagcuuacauuuagauacauucuacggagcgauagcaaaagacauuaacgguaauaucauaacgaauacaaacggaaagaucgccccuaacuaugucauaagaaaagaauuaucgaaacuaaaagaaacugacauagagaauauuguggaucccguugugcgaggaaaaauaaucgaagcuaagaaaaacaaauugauuacauucaauaagucaggagccguaauuaaaacaaccauauggaugaaagaaaaucaaauacccaucaauaagguaagaguauacaguucauuaaaaaauccauuaccugauuuuaagaaacacagagaucuuucucaccucacguacaaacaacaauacaaugucagcaaugaagaaaauuacugccuagcaauauaugaaggcaaaaacaaaaaaggcaaugucugcagaacuugugaacuugucaacaugauagacgcugguaacuauuauagacuaucuaauaaaaauuggaagcaacaauaccccauaguacccgaaaaggauaguguaacaaacuacagcuuaaaaacuauaauaacaaagggccuaaugguauuauuauacgaaaaaagucccgaagaaauaugggaauuaaccuauaaccaacagauggaaagguuauacgaaauuacacaacucgauacagagaaaucugccgaaaucaaacuacuuuuucaucaagaagcuagagagaagaaggugauuacagaauacaugggcuuaaaaaccggaaugaaaggagguaaaaauauaggaaaacacaaagaauucccauggauaaagguagggcccaacuccuucgacgccuuaauagaaggaauagauuuuaaauuaacacccacgggaaaaauaauaaaguuguga

SEQ ID NO: 9182 - RNA, 4374 nt, Artificial Sequence
  Cas9 variant
augaaaaccaucuuaggauuagauuuaggaacaaauucaaucgggugggcaaaaguuucgguagaugacuacggcaacuaccugcacgacauaaaauuaggcucuagaauaauaccaaugucacaagacgucuuaggaaauuuugauaguggcguaacgguuagucaaacagcucaaagaacagaguuuagaucaaaaagaagauuaguacaaagaaauuuacaaagacgcgaaagauuacauagaguauuacauguccuagauuuccuaccggcacauuacgaugcggcuauaggaugggauagaacagaagccguuacuuacggaaaauuucuuaaucaugcagaacccaaacuagcaugggaggaauuagguaauggaaaaagaagguuucuauuuauggacagcuuucaugaaauggucgcagacuuugcuagaugccaacccgcacucguagcugacgguaagaaaauuccacucgacuggacuauuuauuaucucagaaagaaagcauuaacacaagcgauaacaaaagaagaacuagcauggauacugcucaacuucaaucagaaacgaggauauuaucaauuaagaggggaagaggaagaggaaaaucccacaaaacaggaagaauauuacgaacuuaagguaguauccguagaagcuacagauucaaggaaaggaaacgauacuugguacaacguacaucuagaaaacggcuggauauauagacgaagcuccaaaauuagcuuggacgauuggguaggaaaagucaaacaauuuauaguaacaacagaguaugagaaagacggcgcaacguuaaagacggauaaggaaggauauguuaaaagaucauuucgagcuccaaacgaaaaugacuggggauuaagaaagaaacgaacggagacgcuccuagaaaugagugggaaaacuguaggcgcuuuuauauaugaccaccuauuacaagagccagcugauaaaauacgcggaaauuuuauaagaacaauagaaagacauuauuacaaagcagaauuagaggcuauauuagcagaacaauguaaauaccacaucgaacuuagagauaaagaaauguuagaagcaugugcaagagaguuauaucucaacaaucugccucaccaacggagcuuaaugaagaaagauaugacauacuuacuacuauaugauuuaauauuuuaucaaagaccccuaaaauccaagaaagcauugauagcgaacuguccguacgaauauuacgaauauguagacaaagaaacaggagaaauaaaaagacagaauaucaaaugcauagcuaaaucaaauccuuauuuucaagaauuucggcuauggcaauuuguuuuaaaccugcggcuauucgacagaguagaagacaaagaagucacagcaaauuaccuaccgaccgcagacgaucacgcaagacuuuuuaccuauuuaaacgacagaaaagagauuaaccaagaaacacuacuaaaagauuauuucaaacuuaagaaaguaaaaauuggaaaugaaaaagaauauccaauuagauggaacuauauagaagacaaagaaaagaaauauccuugcaaugagacaagauacgaguuacucauggcgcuagauagagcgggaaucgaacauaaaugguuagaugacaauaaccuagaauacagguuauggcauuuacuauacucgguagaaguuaaaucugaaagcgagaccgcccucagaaaacucaaaaacgaugaugcauucguaaauuccuucuuaaaagucaaaccauucaagaaagaauacggagcauauuccgaaaaagcaauuaaaagacugcuagcaguuaugcgaaaaggauuccuauggaacgagcaagauauuugcgaugaaacuagaaaaagaauagaaauaauaauuaaaggugacguagaugaaaaaguaaaagaaagaaugggacacgcugcauauagcuuugauagaguaucagacuuucaaggcuuaccggaaugguuagcaugcuacguaguguacggacgucacagugaggccauggauauccaacacugggacucaccugaacgauuaauggcuuauauaaauaauuuuaaacaguauuccuuaaggaacccaauaguagaacaguguauucuagaaacucuucgcaccguacaugauauuuggaaagaaacaggacagauagacgaaauacacguugaauuagguagagaaaugaaaagcacgagcgaagagagagcucgucgcacacaaaauguuuuaagaaacgaaaacacgaaucuaaggauaaaauccuuauugauagagcucaaaaacgacacagauauaugcaacguacauccuuauagcccaaugcaacaagaaauucuacgcauuuaugaagaaggugcccuacaggaacuaaauagagaagaugaagauuucgaggaaauuucaaaaauaucacaaaugucccaaccgagcggaaaagagcuaaaccgauauaaacuauggcuugaacaaaaauaucgcucaccuuauacaggaaaagcaauuucauuagcaaaacuauuuacacccgcauaucaaauugaacacguaaucccucagaguagauauuucgacgacaguuuuacaaacaaagugaucugcgaagcugaaguaaacacacucaaaucuaaccuacuuggauaugaguuuauaaagaaacauggaggagaaauaauacauugcaccacauuaggcgacguaaggaucuuuucggaaucagaauauaaagcauuugugauggaucacuacgcaaauaauaaauccaagaaagacaaacuccuuauggaagacauaccacaagaguuccuuucaagacaaaugaacgauaguagguacauaaguaaaguagucaaaacguuacuuuccaauaucguacgaauggcugacgaaucugaagcaacaaguaaaucgguaauuguguguacuggcgggguaacagauaggcuuaagaaagacuggggguugaacgauguauggaauagcauaguauauucuagauuugaacgccuuaacagguugacaggaacagaagcauucggacauugggaaaauaaagacggaaaaagagucuuccaaacauccaugccauuagaacuacaaagagguuucagaaagaaacgaauagaccauagacaccaugcuauggaugcguuggugauagcaugcgcaagccgaaauauaguaaauuacuuaaacaacgaaagugcaaacaacccaaagaaaagggaagaccuaagacgccaauuaugcgacaaaaacagagugauacgcaaaccaugggaaacauuuacacaggacgcuuacaacgcauuagaaaaugucgucgugucuuuuaaaaacuacguaaggguaauuaacaaagcaacaaauagauacgagcacuacgaugaaaauggaaagaaacgguucguucaacaaaaaggaagcgagcuuugggcaaucagaaaaccaaugcauaaagaaacauacuauggacacgugaaucuaaggaggaaagaauuaguaacuuuacaaaaagcacuagaugauauaccuuccauaugugacaagaaacuaagagauuauauaucggcauuaguagaaaaacacuucaacaaaagacaauuacuugcgcacuucaaaaguacagacuacuacuggcaaaaacaauauguuaauaaaguuuacgucuggacuuuuucugaugacauaaaaccccuaguagcaacaagaaaacuguuagauaccucauucgacgcuaaaagaauaggaacaauaacggacacgggaauccagaaaaucuuacgcaacuaucuagaggccaaaggcggaaaugccacacuagcauucacgccagagggcaucgcagaaaugaaccagaauauuucaaaauacaacgacggaaaaccacaccagccgauacuaaaaguacgcauaacagaacccaugggugcaaaauauagaguaggacaaacugguaauaaaauggcaaaauaugucgaggcgcaaagcggaacaaaccuauacuuugcgauauaugaagauucugaaggaaaaagaagcuacacaacagucccuuuagaugagguagccgaacgacugaagcaaagauuaagcccuguaccagagaaagaugaaaacgauguaccacuaaaauucuaucuuucaccuaacgaucuaguauaugugccaacagaagaagaauuacaauuacgagagugcaaacuuaacaaggaucgaauuuacaaaaugguuaguucaaccggaaaugagugucauuucauaccauacuacguggcaaacgugauauacaacaagggcggguuuaacaugcaaaugcacagaccacaaucauga

SEQ ID NO: 9183 - RNA, 4374 nt, Artificial Sequence
  Cas9 variant
auggcuaaaauuuuaggauuagauuuagggacuaauagcauagggugggcaauaguugagaaaaacaacagcgauuucacacuuauagauaaaggaguacgaauauuuuccgaaggaguaaaaaccgaaaaaggaauagaaagaucaagagccgcagaaagaacaggauauagaucagcuagaaaaauuaaauacaggagaaaauuaagaaaauacgaaacguuaaaaguauugagcaaaaacagaauguguccauuacaaauagaagacguagaagcauggaagaaauccggauuuaaagacuacccuuugauaccugaauuucuacaauggcuccgcaccaacgaccaugaaaacguaaauccuuacuucuuucgagacaaagcgucacgagcaaaaguaucccugugggaauuaggccgagcuuuuuaucauauagcacaacgaagaggauuccuaaguaaccgcuuggaccaaucaagugaaggagugcuugaagaacacaacccccaaauacaaucauuaauagaagauuuagaagaaacuucaacgauuuuaaacgaaguuagagauuauuacauaaaccuuggccuacuugacggaguuaaaggagacuucaagaaagaacucgacgaaggugagaagaaauuaaaaucccuauacaacacacucauagcuauaauuaagaaaaacgaaaacgauguacaaaaaugcaaagacgaaaucauaaaaagacuaaauaagaaagaagaccuaggaaaaguaaaaggaaaaauaaaagauauaucacaagcaauguuagauggcaauuucaaaacacuagggcaauauuucuauucacucuacaauaaagguaaaauaagaaaucaauacacaucaagagaagaacacuacuuacaagaauuuauuacaauauguaaaguucaggggauaaaugguaucaacgaugaagaaauccuaccagaaaagaaauuuacuggcuuggcuaaagaucuguauaaagccauauuuuuccaaagaccccuaaaaucacaaaaaggguuaauaggaaaaugcucauucgagaaaaauaaaucaagaugcgcuaucucacaccccgacuucgaagaauaccggauguggaacuaccuaaauacaaucaaauucggcacgcaaucagauaagaaacuccgauucuuaacacaagaagaaaaauugaaacugauucccaaauucuauaggaaaaacgauuucaauuucgaaguacuugccaaagaacucaucgauaaaggugccaccuuugguuuuuacaaaaguucccggaaaaacgaguucuuauacugguuuaacuacaaaccgacagacacuguaagcgccugucaguucagugcgagccucaaaaacgcaauaggagaagauuggcaaaccaaagucuuuacuuauaaaacacuaaauucugagaagaaagaaguaauaagaacaguagauuacagagaccuuuggcaccuucucuccgcaaguacuucagauaucuaccucuaugaauacgcaaaagaaaaacuaggcuuagaggacaaaucagccaagacauucucaaaaauaaaacuaaagaaagacuuugcaucauuaaguuuaucagcaauaaauaaaauccucccauacauaaaagaaggacuacuauauagccacgcaguauuuauggcgaacaucgaaaaaguaguagacgaacacauauggaaagauguaaaagaacgaacgauuauacaaaacgaaaucucgaaaaucauaaaauccgauguauucgaaagagaaguaauaaacauaauaaacggacuaaucaaaaacucuaaaacagaaggcgagaacuacgcagaagaaucgaaaaauauuuuuaagacagaguucgauaaugccaucgcaaaaauauuugagaaaaauaacgacaucgaguucaaccagcccuuuuuagaugacaccuaucuuaaauaugucgaagaacuaaagaaauuugauaaagcgagaucauuuuuaccugugccaaggcuugacgaaaaagucauucaauuuuuauuaggcaauaacaaggauggaaugguauacugcucugacaaaaauaaaacaaagaaauuauaccacccauccgacaucgaaauauucaaaaagaaaauaauuaaagaugaauuuggcaacgagaaaaugguacuaggaaguccauuaacaacaaguauuaaaaauccaauggcuaugagagcacuucaccagcugagaaaaguucugaacacucucauuuuagaagaacaaauagacgaaaacacuaggauacacauagaaauggcaagagaacuaaacgaugcgaauaaaagaaaagggauucaagacuaccaaaacgaaaacaagaaauuccgagaagacgcaauuaaagaaaucaagaaacuauacuucgaagaauguaagaaagaaguugaaccgacugaagaagacguccuucgcuaucaauuauggauagaacaagauaagaaagaaauauacgaacaagguaaaagcauacgaauaucagauauaauagggaguaauccagcauaugacauugaacacacaguaccaagaaguaucagucaaaacaauucacuaaugaauaaaacuuuaugcacuccacgauucaaccgagaaauuaagaaacagaaaaugcccauagaacuaucaaauuacgaagaaauauuaccgagaaucgaacacuggaagaaagaagcagaagauuuaacacgacaaauugaaagcauaucaaaaagcauaaaaucagcauccacgaaagaagcaaaagauaaaaacauacgaaggcgucauuaucuuacacucaaaagagacuaccuaaaaggcaaauacgaucgauucaucugggaagaaccaaaagugggauuuaaaaauucacaaauacccgauacaggaaucaucacgaaauaugcacaggcauaccuaaaaagcuacuucaaaagaguagaaaguguuaaagguggcaugguggccgaauuuaggaaacaauggggaauacaagaaagcuauaucgacgaaaacggauucaaacacuauaaagaaaaagacagaucgaaacauacacaucauaccauagaugcaauaacaauagcaugcaugacaaaagauaaauacgacguuuuggcccaggcuuggacaucugaagaugaacaagacaaacaaaaagcaaaaacccuaaugucugaagcaaaaccauggaaaacauucaaagaagacauagagaaaauagaagaagaaauauuagucucucauuucacauuagacaaugucaagaaacaaucaaagaaaaucgucagaguccgcgggaagaaacaauauguugcugaaauugaacgagacguaaacgguaaagcaauggcgaagaaagacgcaaacggaaaaauaaucuauaaauuaaaugaaaaaggcgagaaaauaccacggcuccaacaaggagauaccauuagaggcucucuacaucaagauucaaucuauggggcaaucaaaaacccacuuaaccaagaagaaauaaaauacgucaucagaaaagauuuagaaucauuaaaagcgaaugacguagauaacauaguugacgaaacggugaagcaaaaagucaaagaagccauagaaaauaaaaucuuauuacucucgucuaacgcacaacaaaagaacaaauuagucgacgacguuugguuaaacaaagaaaaacaaguaccuaucaagaaaguaagaauuuaugcaaacagcguuaaaaacccgcuugaaauaaaagaacagagucuacuuaguaaaagccgaaaagaacacaaacaaaaaguuuacggacaaaacgacgaaaacuacgcuauggcaaucuacgaauuagacggcaaacgugaguucgaacuuauaaauaauuuuaaucuagccaaacuuaucaaacaaaaagaaggauucuacccgcuaaacaaggaaaaagagguuaaaggcaagaaaguucuauaccccaucgcuaaaaguaacuacagagauguaguauuaaaacguggacaacaaguaguauuuuacgauaaagaaguggaaaauccuaaagauauaucggaagucauagacuucaaaggcagaauauauauuauagaaggacucuccauucaaagaauaguaagacccucaggaaaaaucgacgaauacggagucauaaugcuaaaauauuucaaagaagcacgaaaagccgacgagaucaagaaagauaauuacaagcccgacggcguuuuuaaacuaggagagaaucgaccaacacguaaaaugaaucauagucaauucacagcuuucguggaaggaauagacuucaaaguucugccaaccggaaaauuugauaaaauauga

SEQ ID NO: 9184 - RNA, 4377 nt, Artificial Sequence
  Cas9 variant
augacaaaaacgauacuaggauuagaccuaggaacuaacuccauaggaugggccuuaaucaaccaagacuucgauaauaaaaaaggcgaaauccuaggcaugggcaguagaauaauuccaaugacccaagacaucaaagacgaauucggaaaaggcaauaguauaucacaaacagcugaacguacaagauugcgaggaguaaggagguuaauacaucguacuuuacuaagacgagaaaggcuacaccgcguacuaaauauaauuggcuuucuaccagaacacuaugcaaaucagauagacuuugagaagagauucggaaaauuuaagcccgagagugaaccuaaaauaaguuuugauggcaacgauguauuuuuauuugaaaaaaguuaucaagaaaugcuugucgauuucaaaauacaccaaccgcaacugguuucaaacggaaagaaaauaccacaugacuggacaauauacuaucuaagaaaaaaagcacugucgaaaaagaucgagaaggaagagcuugcauggauauuacuaaacuucaaucaaaaacgaggauacuaccaacuacguggcgaagaggaagaagaaacaccaaauaaauuggucgaauuccauucucucaagauuguugaaguuaaugcggaugaaccucaaaaaggaaaaccagaaauaugguacucauugguguuagaaaaugguuggguuuaccgacgggcgaguaaaacuccccucuuugacuggaaagacaaaauaagagaauucauaguaacgacggaaauaaacaacgacgguacugucaaaaccgacaaagagggcacagaaaagcgaucauuucgagcucccaaaccagaagacuggacauuacaaaaaaagaaaacugaauucgaacugucaaaaagugggaacgagguuggugcuuuuauuuaugaaagcauacuucaaaaaccuaaccaaaaaaucagaggaaagcuaauaucaacaauagaaagaaaguucuauaaagaagaauuaaagacaauucuuaaaacccaacuguuuuuccacaaagagcugaaagaugaaaaacuauauaaugcauguauagaagaauuauauaaaaauaaugaagcccauagaucacuacugaguaacaaaggguuugaacaucuauucaucaacgacauauuauuuuaucaacgaccacuuaggucaaaaaaaagccagauuaguaauugcccauuagagaaacgaacuuacaaaaaggaaggaauugaaauaaccgaagguauuaaaguuauuucaaaaucaaacccaauauaccaggaauucagacuuuggcaauggaucaguaaccuaucgcuauacuguauagaaccaaccgagacuaauguaacauccacauuccugaauucuauagaagacuacgaaaaucuauuugaauuucuaaauaacagaaaggaaauagaacaaaaacaucuucuaaaauacuuacuagaaaaccaaggauucaaaggcaaacugcucacaaacgaauuagaaaaauucagauggaauuucguugcagauaaaaaauacccuuguaacgaaacaggaucauuauugcauacgcgccugaguaaaguuaaaaacaucucuccggacuuucuaacaaaagaaauugaacaccaacuuuggcacauaauuuauaguguuacagacaaaauugaauacgaacaggcuuugaaaacauuugcacgaaagaauaaccucgauguugacaguuuuuucgaacacuuuaaaaagaucccuccauuugaaucaacauacggagcguacucggagaaagcgaucaaaaaacuacucccauuaauacgauuaggcaaauacuggaacugggaggcaauagacucuauaucaaaagaucgaauaagcaaaauauuauccggagaauacgacgaaaauauuaaaaauagaguacgcgaaaaagcaguucaccuaacaagcgaaaacaacuuccaaggccugcaagaguggcuagcaaaauacaucguauacgacaggcauucagaaggaaaugaucuaggaaaguggaccucaguaucugauuuagaaacuuaccuuaaagaauuuaaacaacacucuuugcgcaaccccaucguagaacaaguaauaacagaaacacuaagagucgugaaggacauauggauaaaacacgguaaagguacagaaaauuuuuuugacgaaauacacguagaacuaggacgagaaaugaaaaauaauuccgaagauaggaaaagacuaacgaauacaauaacagagaaugaaaauacaaacuuaaggaucaaagcucuauuaauggaaaugaugaaugacaaugacgucgaaaaugucaggccguauagucccagccaacaagaaauacuaaaaauauaugaagacggagcacuaaacaguaacauagaacuggacgaugaaauaguaaaaauuaguaaaaaggcagagccaacaaagucagaacuacaacgauacaaauuguggcucgaacaaaaauacagaucaccauacacaggucaaguaauuccucucaacaaacuauuuacaagcgaauacgagauagaacacguugucccccaaagucgguucuucgaugauuccuucucaaauaaagucauaugcgaaagugccguaaacaagcguaaagauaaccaacucggauuacaauucauuaaaaaccacucaggagaaaaaguugaacugggcuucggaaaaguaguacaaguauuuacagaggaacaauaccuugauuucguaaaagaacauuacagcaaaaaccgaucuaaacauaacaaacuacuuuuagaagaaauaccggaaaaaaugauagaaagacaauuaaaugacacaagauacauaucaaaauucguauccucuauacuaaguaacauaguuagaucagaaaaggacgacgacggccucaauaguaagaauauacucccuggcaacggcaaaaucacgacggaacugaaacgcgacuggggacugaacgacguauggaaugacuuaaucuugccacgauucgaacgaaugaauacuauaacuaauucugaccuauuuaccacuuacaaugauaaauaccaaaaacaccuuccaacuguaccguucgaauauaguaaaggcuuccaaaagaagcgaauagaccacagacaccacgccauggaugccuuaguaauagcaugugcuacaagggaccauuuaaaucuaaugaauaaccaaagcgcaaaaucggaacugaaacgauacgaccuacaaaauaaauuaagaaaaaaagaaccauacuuuaaucaaaaagaaaacaaacaaaaagaagccuuuaaagacuuuauuaaaccuugggguacauuuaccgaagacaguaaaaacgcucuagaaaagauaauaauaucauuuaagcaaaacuuacggguaaucaauaaagcaacuaauucauaugaaagcuacaaagaugaagauggaaauuugcgcauuggaaaagauggaaaaccugaaaaaggacucauaaaacaaaagggacugaacugggccauaagaaagccauuacacaaggauacagugucugggcaaauuaaucuaucaagaauuaaauuacccaacggcaagauacuaacagcgacuaggaaaaacuuggacacaucuuucgaucuaaaaaccauagaaaauucuauaacugacacagggauacaaaaaauacuuaaaaauuaccuccuaagcaaagaaagcccugaacuugcauucuccccagaaggacuugaagaaaugaauaacgaaauugaaaaauauaacaacggcaaauuucaccacccaauaaacaaagcacgaauauacgaauuaggaaguaaauucaacguaggucaaacgggaaauagaagagauaaauuuguagaagccgccaaagggacuaacuuauucuuugcuauauaucaggacgaaaacaagaaucgaucauacgaaacuaucccacuaaaugaaguuauagaacaccaaaaauggcgcgcuucacuccccaaagaagaacaagaaaaaauaccacucgucccaguaaacaaacuaaaagguaccuucaucuuuucauuaaguccaaacgaccuuguauacguaccaagcaacgacgagcuagaaagauccgcaagcauagacuuuucuaagcucaagaaagaacaaaucaaccgacuuuacaaaaugguaucaucaucgggaucgcaguguuucuuuguaaaaagcgaaguagcaaccagcguaguaaacaaaauggaguacucaucccuaaacaaaauggaaaaaucgauagauaaccugaugguaaaggaaauaugcauaaaauuaaaaauagaucgucuaggcaacauaucaaaagccuga

SEQ ID NO: 9185 - RNA, 4377 nt, Artificial Sequence
  Cas9 variant
augaagaaaauacucggacuugauuuaggcacaaacagcauugguugggcauugauagaacaagauuucgaaucaaaagcgggaaaaauauccggagcagguaguagaauaaucccaaugagucaagauauauuagggacauucgaaacuggccaauccuauucccaaacugccgacagaacacauuaucgauccauacgaagauuguaucaaagaacaaaauugcgucgagaacguuuacauagaucacuaaauguacuaggauuccuaccagaacauuauaaaaaugaaauagacuucgaacaacgcaaagggcaauuuuauccaaacaaagaaccaaaaauagcauauuacccagaacaaguggcaucaaaaguuaaauaucaauucuuauucaaaucgucuuuccuagaaaugguagaagacuucaaaagacgaggauacaacggugccauaccuuaugacuggacaaucuauuaucuaaggaaaaaggcuuuagagaagaaaauagaaaaagaagaacuugcauggcuucuucuuaauuucaaccagaaaagaggauacuaccaacuccggggugaagaagaagacacaaauaguaacaagaaagaagaauuuuacgaacuaaaagugaguucagucgaacaaacucacgacacaucaccaucagggacaugguacaauguccauuugcaaaacggcuggguuuacagacgcaaaucaaaagacucacuuaaagacugggaaggauuaaacaagaaauuuaucguuacaacacauuugaaugcugauggcucggaaaaacuugauaaagauggaaacgugucccguagcuuuagagcaccuaaagaagaugauuggggucuagucaagaaacgaacagaaagcguacucgagaaaaguggguuacauguaggagaauuuaucuaugaaucacuucuagaaaacccugaacagaaaauccgaggaagccucauaaaaacaauagaacgaaaauauuauaagaaagaacuugaagccauacuagacaaacaaaccucuuuccaccgagaacugagaaaugacgcauuauauaaagaagcgacucuagaauuauaucccaaaaacagcgcccacagaagcaauaucaaacaaagagguuucaaauaucuauuuauagaagauauuaucuucuaucaacgaccucucaaaagccaaaaacacuuaauugcccacugccaauaugaaaaacgaaccuacaaaaacaacggcggagaaacuauagaagucagucuacaaggagcaccaaaaucacaccccagcuuccaagaguucagaauuuggcaauucaucuccaaucuucgauuuuaugacaaagaagaaauaguugaaggacaagaaguaucuauuacagaaaaacuccuuaaaagcgauuccgauuucgccgaauuauaccauuggcuaagccaucaaagagaaguagaccaaaauaaaacacuuaaauauuucacccaaaagaaacuaauaccuaaacaaaagaaagauaaccccacuaucagauggaauuuccccgaagacaagaaauaugaaaugggagaguucaaagcacaacuauugagcagauuagaaaaaguaagaaauugucaaccagauaaauuccuaacucagaaaaacgaauuagaccuauggcauaucauuuauucugugaccgauaaaacugaguucgaaaaagcacucguaacauuugcagagaaaagagaacuagacagugaauccuucguagaaaacuuuaagaaauuuccaccuuucaaaaaugacuacgcuagcuacucacuaaaagcgauuaagaaaauacuccccuuaaugagacgaggcaaauauuggaaagccgaaaacuugggaccccaaacucuacagcggauagagaaaauaguaaacggugaagcagacgacaaaaucucuauacgcgcgagaaaauuggcacuucaccuaaaugauacuaaaucuuuccaaggucugccaacaagccuugcauguuacguagcauauaaucggcauagcgaaaaugaagaaaaucaaaaauggcaaacaccaucugacauagacaaauaccuaaaagacuucaaacaacauucacuccggaacccgauaguagaacaacuuauaacagaggcuuuacgcguaguuagagacauauggaaacauuacggacaggggcagaaagacuucuuugacgaaauacacgucgaacucggaagagaaaugaaaaacccagcaauaaaaagaaagaaacuaagccagaaaauacaagaaaacgaaaacacaaauuacagaaucaaagagguuuuacgaaauuuaaaagaaaacaacauagaugcgaaaccauacucuccaagucaucaagaaauacuuaaaauauaugaagaaggugucuaccaauccauagaaaacguagaagacgaaauagagaaaauuaggaaaaauaauacuccaucauccaaagacauuaaucgauaccgguugugguuggaacaagguuacauuagucccuauacaggagaagucauaccacuaucacaacuauucucuaaucaauaugaaauagaacauauaaucccuagaaguagauuuuucgacgacucacucgcaaacaaaguuauaugcgaaagcucuguaaaugcauuaaaagacaauaaaacugcacuagaguucauaacaaaucacggaaacgaaaaaguugaguucgccgguaaaacuguagaaaucuuaucaucugacaaauacaccgaacauugcaaaagauauuucaaacgaaauagaacgaaacucaaaaauuuacuaucauaugacgucccagaaggauucauaaauaggcaguugaacgacucuagguuuauaucaaaauacgugcgaaacuuacuuagcaacauaguccgagaagaagaagaaagagaagcuaucucuaaacauauuuuaaccaucccuggauccauaaccucacaauuaaaacaagacuggggguuaaaugaaaaauggaacgaaguaguaacucaucgcuucgaaagacucaauaaccuaacugggacaacggauuuuggcuucugggauaauaaaauaaaugcauuuagaauaacuguuccaaaagaauuaagcaaaggauuuaacaagaaaagaauugaccacagacaccauacucuagacgcauuaguuaucgcggcaugcaccaaagaccacguaaacuauauaacuagccuaaacacugaacguaauaaccacucucuagucucaaaauuacgaaacaccaagaaaguucuaauuaaugggaaagaacgccgaauagcuaaagcauacaaauuacccugguccuccuuuccccuugaugcgaaacaccaauuagaaacuacuguaauuucuuuuaaacaaaaucuaagggucauaaauaaaaguaguaacaaaacauggcaauggagaaauguaaacggcgaacagaaaaagaaacuaauaccacaaacaaaaggagauucaugggcaauacgaaagucaaugcacaaagcuacaguaucugcuaaagucgaaucaguaggaaaagggaaaauaaaaacuacaaaccggacaccccuaggcgagauaaaaggcgagaaacacguagagaaaauuuaugacgcccguauacgggaaguuauaaucccaaaucauuuaaauaaauaccucgaugaaaaaggcaaaccaaauuacgaagcggcauuuagccaaaguggaauaaaacaacucaaugaaaacaucgaaguccuuaaugaagguaaaccacacgcuccuauauauaaaguaccauuauuugaagucggaucaaaauuucccguuagcgaagaugccaagaguccuaagaaucaaaaauacguugaagcggacaaagguacaaacuuauucuucgcugucuauuggaacgaagaaaaacagaaaagaaauuuugaaacaguacccuuacaccaaguaauaguacaccaaaaacaagucgccagccuucccacagaacaacgaacaagcguuccaauaaaaccagaacuaggauuguuucuauucagccucagccccaaugaccuaguuuaugucccaaccgaagaagaaauagaaaauccacaucuaguugaccuuaaaaaccuuucaaaggaccaaacaaacagaaucuauaaaaugguaucgaguacgggcaacgaaugucauuuuauaccucaccacauaucaagacucauaaugaaguauaacgcaaaacaaaaaguaggcgaguucggaucacuaaacaaagcagaaaaagcuauaaccggagagacaaucaaagaaaagugccugaaaauacaaauaaauagucuagggaaacucaaaaccgaaagaauagcuuga

SEQ ID NO: 9186 - RNA, 4380 nt, Artificial Sequence
  Cas9 variant
augaaauucaaccuaggauuagauauaggaacaaauuccaucggaugggcauuaguuaacgaagauuacgaaaacaagaaagguaaaauaauagcagcugguucacgaaucauccccaugacucaggauauccuagauaaauucggaucaggcgcuauuacggaaacacagacagcccuaagaacugacuauagaucaaaacgaaaacuuauacagcguuuucuacuacguagagaaagauuacauagaguacuuaacguauuagacuuccuaccuaaacacuacgccgaaucaaucgacuuugaaaaauacuucggaaaauuucuaccaaauacagaacccaaacuggcuuauaaccaaaaucaauucaucuuucaaaauucauuccuagaaaugcucaaagaauuucaagaaaaacaucccgaacuucuaaccaacaacaagaaaauaccauacgauuggacaauauauuaccuacguaagaaagcguuaaaucaacgcauagaaaaagaagaauuggcauggcuccuuuuacaauucaaucaaaaacgagguuauaaccaauuaagagaugaagaagaagaauccguucccaauaaacaaguagaauuuuauagccucaaaauaauugacguaguagcagaccaaccaaaagaaggcagagauaaaaggugguauucaauaaaccuugaaaaugguuggaccuaccgcagagaauccaaaacaccacuauucaauugggaaggaaaaacaaaagacuucauaguaacuaccgauuuaaaucaagacggaucuaucaagaaagauaaagaaggaaaagagaaaagaucauuuagagcaccauccgaaggggauuggacacuauugaaaaagaaaacagaaaaagaaauauacgaaucaggaaaaacgcuaggaacuuauauauacgaugcacuacuaaacacuccagaucuaaaaauuaaaggggauuuuauaaggacgauagaccgaaguaucuauaaagaagaacuacaacaaauaaucaauaaacaaaaagaauaucaccuagaacuaaacagcucaaaacuauacaaagcaugucuagaagaacuauaccccaaaaacgaaauauacaaaagcgcccuuaaaaacaaagauauagcauaucuauuuauaaacgauauacuauacuaccaacguccccuaaaagcacccaaauacaacauaggaaaauguacauacgagucaagaacauucaagaaagaagauaagaaaauacgcgaauauaucccagcagucgccaaaagucauccacucuuccaagaguucagacuauggcaauggauuaaaaauuuaaaaauauacgaaaaauuaagcucugauaacuguaccgacuuuuuccuuacgaacgaacaagauuucgaaaaucucuucgaguuccuauggaacaagaaagaaauagaccacaaaggcauucuagaguacuuaguuaaaacuaaauuccccgaccuaaaaccaaaacaaguaaaaacaaaaguaaaagaauaucgcuggaauuacguauacgaccaugagaaagacgaaucaaaaaccuauccauguggagagacauauuuucuucugaaaaacaaacuagauaaaaucuacaaugcacaggaugauuuccuagacaaagaacgccuauacaaucuguggcauauaauauacucugucacagacaagaaacaauaugagaaagcacuagcaaaauuugcccucaaaaaccaucucgauaccaaaucuuucguaaauaccuucaaaagaauaccaccuuucaaaaaugacuacgcuaucuauagucucaaagccauaaagaaacuacuaccccuaaugagaguaggaaaauacuggaauuacgaugauauagauccuaucacuaaacagaaaauacaguguauuaucaccggagaagaaaaugauacaauaagcacauugguucgagagaaaacaaaccacuucuccaacgaaaaugauuucaaaaaucuaccacuauggcuggcaggauacauuguauacaauucacauaacgaaucgucagagauagaaaaauggaaaaguccucaagacaucgauacauuccucaagaaauucaaacaacaugcacuacguaacccaauaguggaacaaguuguuacugagacguuacgagugguacgagauauauggucuaagaaaggacaaggcaagaaagacuucuucaaugaaauccauauugaacuugguaaagaccucaaaaaucccgucgauaaaagaagaaaacuauccucaaccaauacgaaaaacgaaucaacuaauacuagaauuaaagccuuacuaauugaacuauucacacaaggaguagaaaauguaaaaccaaacucgccaaaacaccaagaaauucuaaaaauuuuugaagaaggagcucuaaauagcggcauagaaauagaagaggacauaauuaaaaucagcaauacagaucaacccacuaagaaacaauuagaguuauauauccuaugguuagaacacaaauacaaaaguccuuauacaggccagagcaucccccuaagcaaacuauuuacuccgaauuaugagauagaacauauaauuccuagaucuaaauauuacgacgauaacuuaagcaauaaaguaauuugugaaacggaaaucaaucgacucaaaaacaaccagcuaggcuacgaguucaucaacaaucacgagauucgagaggugacccuagaagaaggaaaaacaaucagacucuuaaguccugaacaguacuggaauuucguaacuaccuauuaugccaaaaacaaagcaaaaagagaaaaccuacugcuaaaagaacuucccguacaaaugguugaaaaacaacucaacgauaccagauacguuaguaaauaugucaugcaacuucuuucgaaaauuguaagaaaagaagacggaacagauaauggcaucaacucaacaaauauacuaagcauauccggaaaaaugacucgagcacugaaaaaugauugggaucuaaaugacguauggaaugaucuucuauuauacagauucgaaagacuaaauacaaucacgaaaaccaacuuauuuaccacauacucagaacagaagcagaaaagaaugccaaucguaccagaccaauacgcaaaaggcuuccacaagaaaagacuugaucacagacaccacgcacucgacgcuauagucauugcuugcauaacaagaaaccacauaaacuauaugaacaaccaaaacauucaaggggaaaaauugaagaaaaaugcgauugaaaaagaaaacuacagagaaauacuacaaaaaucaagauuagacauaagagcgcaauuaugugaaaagaaauauaacgacaacgacccuacaaaauacaacuggguuuucaucaaacccugggcagauuuuacagaaaauacaaaagacauacuugaauccauaauaccuuccuucaaacagaacuuacguauuauaaauaagaccgucaacuacuacgaaaaauauaacgagaauggcaagaaagugaaaguucgccaaauaaaaggagauaauugggcgauaagaaaaccgcuacauaaagagacaauuucaggaaagguccacuuaaguuacaaaaccccugccaaggguaaaauauuaacagcaacaagaaaaguacucgacucauccauggauuuuaaaaguauagagaaaauaacagacacgggaauacagaaaauccuuaaaaauuaccucgaauacaagaaaagcccagaauuagcguucagccccgagggaauagaagaacuaaaugccaccauaacuaaauacaacaacggauuccaccauaaacccauuuauaaaguacgaauauaugaagaaggagucaaauucccucucggaaacaaaggaaacaagaaauccaaauauguagaggcagaaaaagguacuaaccuauuuuucgcgauauacaaagaccaagaaaacaaccgauauuucgagacaauaccauucaacgacguccucgaaacucucaagaaaggaauguccgcaguuccugagaaaaaucaagaagaaaacacauugguauucgcacuaaguccacaagaucuaguauucguuccuacauuagacgaaauugaaaauccagauaucguugacuucaaaaaccuaacuaaagaucaaaccaacaggauauauaaaauggucagcagcucuggaaaacaaugcuuuuucauaaaagccgaaguagcuaccagcauaguaaacaaaauggaguucucaacgucaaauaaaauggaaaacucaauugaagguauucaaaucaaauccaacugcuggaaauuaaaacuagauagacuuggaacgauaacuaggguaaucaaguga

SEQ ID NO: 9187 - RNA, 4383 nt, Artificial Sequence
  Cas9 variant
augacaaaauucaacuuagguuuggacauuggcacaaacucaauugggugggcucucguuaaugaagacugugaaaauaaaaaaggaaaaauucuagccgccggaucacgcauaaucccaaugacacaagacauccuagauaaauucggaucaggagcagcuacggaaacacaaacagcacuacgcacugauuaucgaaguaaacgaaaauuaauacaacgauuucuacuacguagagaacgccuacaccguguauuaaacguacucgacuuuuuaccuaaacauuaugcagaaagcauagauuuugaaaaauaccucgguaaguuucuacccaauacagaacccaaacuaguauacaaccaaaaccaauuuauauuccaaaacucauuuuucgaaauguugaaggaauuccaagagaaacacccugagcuguuccuaaacaaccaaaaaauacccuaugacuggacaauuuauuaucugcguaaaaaagcacuaucucaaaaaaucgaaaaagaagaacuagcauggcuccuucuacaguucaaccaaaaaagaggauacaaucaauuacgagacgaggaagaggaaaacacaccagacaaacuagucgaauucuacucccucaaaaucauaaaagucacugcagacgaagcaaaagaaggcaucaacaagagaugguauaguauuaaccuagagaaugguuggauauaucgacgcgaaagcaaaaccccacucuuuaacugggaaggaaaaaccaaaaauuucauaguaacaacagaccuuaaucaagauggcucaaucaagaaagacaaagagggaaaagaaaagagaaguuuucgugcccccuccgaaggcgacuggacauuacuaaaaaaaaaaacggagaaagaaauuuacgagaguggaaagacucuaggaacauauaucuacgacgccuuacuaaauaaucccgaccuaaaaauuaaaggcgcccuaauaaaaacuauagaucgauccauauauaaagaggaacuacaacaaaucauaaacaagcaaaaagaauaccauucagaacuaaauaacagcaaacuuuacaaagcuugcuuggaagaacuuuacccaaaaaaugaaaucuauaaaaacgaacucaaaaacaaagacauagcauaucuauucauaaacgacauauuauacuaccaaagaccauuaaaagcucccaaauacaacaucgggaaguguucauacgaaucuagaacauuuaaaaaagaggauaaaaaaauaacagaauucaucccugcaguagcuaaaucccacccacuauuccaagaauuucgacuauggcaauggauaaaaaaccuaaaaauuuacgaaaaauuaacaaacgacaauuauacagauuucuuuuuaacaaacgaacgagacauugaaaaacuauucgacuucuuauggaacaagaaagaaauagaucauaaaggcauacuagaauaucucaucaaaacuaaguucccagaccuaaaaccgaaacagguaaaaaguaaagucaaagaauaccguuggaauuauaucuacgaccacgaaaaagacgaaagcaaaaacuacccauguggagagacauacuuccuacuuaaaaauaaacucgauaagauuacuucaauacaagacgacuuccucaacaaaaaacgacuagaaaaucuuuggcauauaaucuacucagucaccgauaagaagcaguaugaaaaagccuuagcgaaguuugcacuaaaaaaccaauuagacacaaagucauucguaaacaccuuuaaacgaauacccgcauucaaaaacgacuacgcaaucuauucauuaaaggcaaucaagaaauuacuaccgcuaaugcgcguagguaaauacuggaacuaugaugacaucgacccuaucacaaagcaaaaaauccaaugcauaauaacaggagaagaaaacgacacaauaagcacauuaguccgagaaaagacaaaccauuucucuaaugaaaaugacuuuaaaaaccuaucucucugguuggcgggauauauagucuacaauucucauaaugagaguuccgaaaucgaaaaauggaaaagcccccaagauaucgauacauuccuaaagaaauucaaacaacaugcauugaggaauccaauaguugagcagguaguaaccgaaacauuaagggucguccgcgacauuuggcuaaaaaaaggacaagguaaaaaggacuucuucaacgagauccacaucgaacuagguaaagaucuaaaaaauccagucgacaaaagacgcaaaaucucaucaacuaauucaaaaaacgaaacgaccaauauacggauaaaggcccuacuuaaagaacucuuaaaagaaggaauagaaaacaucaaaccuaacucuccaaaacaacaagaaauuuuaaaaauauuugaggaaggaauauuaaauucuggaauugacaucgaggaagagauaauaaaaaucucacaaauugcacaaccuacgaaaaaacaacuccaguacuacagaaacugguuagaacagaaauacaucucaccauacacggggcaauuuauaccacuuucaaaauuauucacuucaaaauacgaaaucgaacacauaaucccgcgcucuaaauauuaugacgacucacuuucaaacaaaguaauaugcgaaacagaaauaaauagacuaaaaaacaaucaacucggcuaugaauucauaaauaaucaugaaauaagagaaauaacacuugaagaaggaaaaacaauccgucuacucucaccaaaacaauauuuagauuucguaacaacuuacuacggaaaaaacaaagccaagcgagaaaaucuucuucuaaaagaaaucccuauccaaaugauagaaaaccaauuaaacgacacuagauauguaucaaaauaugucaugcaacucuuaucuaaaaucguacgaaaagaagauggaacagauaacgguacaaacucaaucaauauacuaucaguuucuggaaaaauuacccggguccuaaaaacugacuggggucugaacgacguauggaacgaccuacuuuguuauagauucgaacgacuaaacaaaauaacaaauaccaaccucuucacaacauacucggaacaaaaacaaaaaauaauaccaauaguacccgaucaauacgccaaaggauuucacaagaaaaaacucgaucauagacaccaugcucucgaugcgauauuaauagcauguaucacucgaaaucauauaaauuacaugaacaaucaaaacauacaaggagagaaauuaaaaaauuucaaaauagacaaacacaacuaucacgaaauauuccaaaagucaagauuagauaugagagcccaacuuugugaaaaaaaauauaacgaucacgacucaacaaaauacacuugggucuuuacaaagcccugggccgauuucacagaaaacaucaaggacacccuagaauucaucauuccaucauuuaaacaaaacuuaagaauaauaaauaaaaccguaaauuacuaugaaaaauacaaugaaaauggaaaaaaaguaaaaguaagacaaacaaaaggggacaauugggccauaaggaaaccucuccacaaagaaacuauuucaggaaagguacacuuauuauauaagacuccagcaaaaggaaagaucuuaacugcaacccguaaaguucuugacagcaguauggauuuuaaauccauagaaaaaaucacugacacagggauucagaaaauauuaaaaaauuaccuaaaauauaaagaaucgcccgaguuggccuucuccccagaagguaucgaagaauuaaauauuacaauagccaaauauaacgauggauuuuaucacaaaccaauauauaaagucagaauuuaugaagaaggcguaaaauucccauuaggaaaccgaggaaacaaaaaaaauaaauauguagaagcagaaaaaggcacaaaccuuuuuuucgcgauuuacaaagaucaagaaaacaaccgauacuucgaaacuauaccauucaaugacguacuagaaacacuaaaaaaaggaaugucagcaguaccagaaaaaaaucaagaaaaaaacacacuaguauucgcccucucaccucaagaccuaguguucguaccaacucuugacgaaauagaaaaccccgacauaguggacuuuagaaaccuaacaaaagaccaaacaaacaggauauauaagaugguaucaaguucaggcaaacaauguuuuuuuauaaaagcagaaguagcaaccuccaucguaaacaaaauggaauucacaacaucaaacaaaauggaaaacagcauagaaggaauacaaaucaaauccaauugcuggaaauuaaaacuugacagauugggaaccauaacaagaguaauaaaauga

SEQ ID NO: 9188 - RNA, 4389 nt, Artificial Sequence
  Cas9 variant
augacgaaaaauauuuuagggcuagauuuaggaacgaacucaaucggaugggcguuaauaaaacaaaauuuugaaaauaaacaaggggaaauauuagggaugggaaguagaauaauaccuaugagucaagauauacugggugauuuuggcaagggaaacucaguuagucaaaccgcagaacgaacgaaauauagaagugugaggagauuaagagaaagguuuuuacuuagacgggaaagacuacaccgaguacuaaaccuguuaaacuuuuugccccaacauuacgcuucccaaauugauuucgaaaaacgguucgguaaauuuaaaguagaaacugaaccgaaacuagcuuggaaaaauaucgauggacaauucucauuccuguuccaaacaucguucaaugaaauguuagaagacuuccgcguaaacgggcaagauguaaaaauaccauaugauuggacaaucuacuaccuaagaaagaaagcacuaaguaagaaaauagaaaaagaagaacuugccuggauauuacuaaacuuuaaccagaaaaggggauauuaucaguuacgcggagaagaagaagaagaaaauccaaacaaauuaguagaguuuuacucacuaaaagucguggauguaguagcagaugaaccucaaaaaggaaaauucgauauaugguacucauuaauacucgaaaauggauggguauauagaagaagcucaaaaauacccuuauucgacuggaaagauaaaacaagagauuucauagucaccacugauuuaaaugaugacgguagcauaaagaaagauaaagaugguaaugaaaaacguucauuucgagcaccuagcgaaaaugauuggacccugguaaagaagaaaacggaacaagaaauugaacaauccaggaaaacaguugggacuuauauuuacgaagcacuauuggauaauccgaaacagaaaauaaaaggcaaauuaguaagaacaaucgaaagaaaauucuacaaagaggaacuucgccaaauacuugaaaaacaaaaagaauuucaccaagaacuacaauccgacgaccuauacaaugacugugugcgcgagcuauaccggaacaacgaagcucaucaacuaacgcuuuccaagaaagauuucguacacuuauugauggacgaucugauauucuaucaacgaccucucagaagccaaaaaucaucaguauccaacugcacacuagaauuucguaaauacaaagaugaaaacggugcagagcacacucaauaucuaaaagcuauaccuaaaagcaauccauacuaccaagaauuuagauuauggcaauggauauauaacuuaaacauauacagacgagaagaugaacaaaauccuauaacaggagaauuuuugucuacaacuaaagaauuugaaaacuuauucgaauuuuuaaacacaagaaaagaaguagaccaaaaagcacuucuaaaacauuucaaauuaaacgacaaaacacaucgauggaauuucguagaagauaagaaauacccauguaaugaaacaaaaaccaugauaaguucgcgauuagaaaaaguagaaaacauaucagaugacuuuuuaacaagggaaauagaacagaaaauauggcacauaauuuauuccgucaacgacaaaauugaauaugaaaaagcacuaaaauccuuugcuaagaaacaccaccuagaugaauccagcuucuuugaagcauucagaaaauuucccccuuuuaaaucagaauauggaucauuuagugaaaaagcuguaaagaaacuauuaccacucaugcgguuaggaaaauacuggaacuacgcagacauagauaaaucaucgaaagaacgaauacagaaaauuauauccggagaauacgacgaaaauaucaaagauagaguaagagaaaagucgguucaccugaccacagaaaaugauuuucaagguuuacaacuauggcuagcacaauacauuguauauggccgacauucugaagccagcaugauuggaaaauggaauagcgccgaugaccucgaggaauuucuaaagaauuucaaacagcacucauuaagaaauccaauaguagaacaaguuaucacagaaacauuaagggugguaaaagauauaugguuaaaauacggaaauggggcaaaagacuuuuucaaugaaauacacauugaacuuggccgagagaugaaacuaccagcuaaagaaagagaagauuugacccggaaaaucacagaaaacgaaaacacaaaucuaagaauaaaagcauuauuagcagaaaugaugaaugauucguccgucgaaaacguacgcccauucuccccuaugcaacaagaaauucuaaagauauaugaagauggaguauuaaauucuggaaucgagauagaggaugaauauuuaaaaauuucaaaaacagcacaaccuuccccaagugauuuaaaacgauacaaacuauggcuagaacaaaaauauaaaucacccuauaccgggcagauaauaccuuugaauaaacucuucacaccagaauaugagauagaacacauuauaccgcaaucuagauacuucgaugacaguuuuaguaauaagauaauaugcgaaagcgcuguuaauaaauuaaaagauaauuacauaggcuuaggauucauuaaacaauuuggcgggacuauuauagaauuaggcuuugggaaaucaguaaaaguauuugaaacugaagaauacgaagauuuuguaaagaaacauuaugcaaacaacagaagcaaaagaaacaaauuauuauuagaagacauucccgagaaaaugaucgaacgucaaauaaacgacacaaggcacauaucuaaguacauuucaggcguacuaucaaauauaguuagaauagaugaugaucaagcaaagaaaaucauagaagacgcagaaauauuagcacguaaagaaauagauaaggacaaagcaaacgaaauaagacggaaagccaaaagucuagcaacagaugacgggauuaacuccaaaaacauaguccccggcaacggcaaaauaacaacacaacuuaaacaagauuggggauuaaacgacguguggaaugacuuaauuuuaccccgauucgaaagaaugaaccaacugacuaacucaaaagacuucacaguauggaaugaaaaccaucaaaaauauuuaccuacuguaccaauagaauuuuccaaaggauucucaaagaaacgcaucgaucaucgacaccaugcauuagaugcucuaguaauagcaugugccacgaaagaccacguaaacuuacuaaacaaucaaagcgcaaaauccgacacaaaaagauaugaccugaaaaagaaacuaaugaaauuugaaaaaguggucuaccaccacacacaaacuggaaauaaaaucgaaagagaaauaccgaagcaauuccuaaaaccaugggaaaauuucacauucgacgcuaaauacaacuuagaaucuaucauagugucauuuaaacaaaaucucagggucaucaauaaggcaaccaacuauuacgaaaaauauguagaaaaggacggcacuaaaaacaaaggacguguagaacaaacagguacuaacugggccauaagaaaaccaaugcacaaagauacagucagcgguaaaguaaacuugcccuggguaaaagugccuaaaggcaagaucuugacagcaacaagaaaaauccucgacacaucuuucgaccucaagucuauuggcagcaucacugauacaggaauacagaaaauacuucgaaauuaccuagaauuuaaaggauccccugaacuagccuucucaccagaaggaauagaagaccucaacaaaaauauugaaaaauauaaugacgguaaaccucaucaaccaauaaauaaagugagggucuucgaauuggguucaaaauuucaagucggucaaacagggaauaagaaagacaaauacgucgaagcagcaaaaggcacaaaucuauucuucgcuguauacgaagacaaaaaugguaaaagaagcuacgaaacaaucccccuuaacgaaguaaucgaaagacaaaaacaaggcuuauccguuguagaucuaaaaggaacuaaugacuuuuacuuguguccaaaugacuuagucuauauaccaagugacgaugaauuggaaaauaucaauaacaucgauuucaaaaacaucgcgaaagaaaagaaugaaagaauauauaaaguaguaaguuucuccggaucacaaauauucuucguuagacaagauauagcgacaucaauaguaaacaaagcagaacuaucaacuuuaaacaaaauggaacgagcgauggauggguccaugaucaaagaaucuugcgucaaauuaaacguagacagacuaggaaacauaucaaaagcauga

SEQ ID NO: 9189 - RNA, 4401 nt, Artificial Sequence
  Cas9 variant
augacgaaaaacauccuaggccuggaucuuggaacaaacucaauagggugggcacuaauaaaacaagauuucgaaaauaaacaaggagaaauauuaggaauggggucacgaauuauacccaugucccaagacgugcuaggugaauuuggaaaaggaaauagcguaucacaaacugcagcccgaacagauuaccgaggaguaagacgacuaagaaaaagauuucucuuacguagggaaagacuacauagggugcuuaacguucuaaacuucuuacccguccacuaugccucacaaauagacuuugagaaaagguucggaaaauucaaagaagauacggaacccaaacuagcguacaacaaagaaggauuuauauuuaaaaauagcuucgaagaaauggucgcagauuuuaggaaacaucaaccacaauuacuagaaaacgauaagaaaauacccuacgauuggacaauauauuacuuaagaaagaaagccuuaagcaagaaaauagaaaaagaagaauuggccuggauccuacuaaacuucaaccagaaaaggggcuacuaucaauuacgaggagaagaagaagaagaaaaccccaauaagcuaguagaauuuuacagucuaaaaauuacagacguacuagcagaugaaccccaaaaagguaaaagcgacauaugguacucacuaauacuagaaaacggcuggauauacaggagguccagcaaaacccccuuguucgacuggaaagagaaaacaagagauuuuauaguaacaacggaccucaaugacgacgguucuauaaaaacugauaaagauggcaaugagaaacguucauuccgagcacccagugaaaacgacuggacucugguuaaaaagaaaacggaacaagaaauagauaaaucccagaaaaccguaggaaccuauauauacgaaacucuucuccaaaacccuaaacagaaaauaaaaggcaaauuaguauguacaauagaaagaaaauuuuacaaagaagaacucaaacaaaucuuggaaaaacaaaaagaguuucaucaagaauugcaaaaugaugacuuguauucagauuguguccaugaauuauauagaacaaaugaagcucaucaacuaacacucuccaagaaagaaauuguaaaccuguucauggaagaucuaauuuucuaccaaagaccacuacgaucacaaaagaccuccauaagcaacuguacacuagaguuccguaaauauaaagaugaaaauggaguagaacauacgcaauuucuaaaagcuauaccaaaaaguaaucccuauuaccaagaguuucgaauauggcaauggauuuuuaaucuuaacauuuacaaaagggaugaugacagcaaugucacuaaagaguuucucaauacaacagaagauuuugaaaaucuauuugaguuccuaaauaaccgcaaagaaguugaacaaaaagcccuccuaaaacauuucaaacuaaacgaaaaauuacauagguggaacuucguagaagauaagaaauacccauguaaugaaacuaaaacaaugauaucaaccagacuagauaaaguagaaaacaucucaaaagacuuuuucacacgcgaaauagaacagaaaauauggcacaucauauacagcguaaacgauaaaauagaauacgaaaaagcccucaaaucauuugcaauuaaacacaaccuggaugaaaacucauucuuugaagcguuuaagaaauuuccacccuucaaaucggaguacggaaguuucuccgaaaaagcuaucaagaaauuacuaccgcucaugcgacuaggcaaauacuggaaugaagaugaaauauuaaaauacucagaugacuacuuuaaaaauauugaaucucuauuaggaguacuaaaacaaagagaugaaaauauaucggaugccgauagggaaaacuauaacaaaacaauaaacaacaaacucagagcagaacucgaaaacuuccaaaacgcugaaauagaaucuuuucaaggguuaagguugcacaucgcacaauauauacuguauggaaaacauucagagggagauaauaagaaauucaacuccgccgacgauuuagaaaaauuucuaaaagaguucaaacaacacucgcuaagaaacccaauaguagagcaagucauaacagaaacucuaagaguuguaaaagacauauggacaaaauacggaaauggggcaaaagacuuuuucgacgagauacauauagaauuagguagggacaugaagaaaaccagagacgaaagagccgaugcaacaaaaauaauaacagaaaacgaaaauacaaaucuacgaaucaaagcccuacucgccgagaugaugaaugacguagaaauggaaaauguucgaccuuacucaccgaugcaacaagaaauacuuaaaauuuacgaagacggaauauuaaaaucagauauagagauagaggaugauauacucaaaaucuccaaaacagcccaaccuucaucuagcgaccuuaaacgcuacaaacuauggcuagagcagaaauacaaaucaccguacaccggccaaauaauaccauuaaacaaauuauucacaccagaguacgagauagaacacauuaucccgcaaagccgauacuuugacgauagcuuuucaaauaaaauaauaugugaaucagccguuaauaaacucaaagacaauuacauaggauuaggauuuaucaaacaauuuggcgguacaaucgucgaguguggauucggcaaaaauguaaaaguuuucgaagcagaagaauacgaagacuuugucaagaaacacuacgcuaacaacagagguaaaagaaacaaauuauuacuagaagagauaccagagaaaaugauagaacgacaaaugaacgacacaagacacauaaguaaauauauuuccggaguuuuaucaaauaucguuaggguugaagacggaagcgaugaagguguaaauuccaaaaacauaguaccagguaacggaaaaauaacaacacaauuaaaacaagauuggggacucaaugauguauggaaugaacuaauucucccaagauuugaaagaaugaaccaacuaacuaauagcacggauuuuacggcauggaacgaaaaccaucaaaaauuccuaccgacaguaccaauugaguucuccaaaggauucagcaagaaacgaauugaucauagacaucaugcccucgacgccuuaaucauagcgugcgcuacaaaggaccauguaaacuugcuaaacaaccagucagccaaaagcgauacgaaacgauaugaccugaaaaagaaacuuaugaaauuugaaaaaguaguauacaaccauccucaaacuggagauagaauagaaagggaagugccuaaacaauucuugaaacccugggauaacuucacauucgaagccaaaaauaaccuagacaaaaucauuguaucguuuaaacaaaaccuaaggguuauaaacaaggccacaaauuauuacgaaaaauucguggaaaaagauggaguaaaaacaaaggaacgcguagaacaaaaaggaacaaauugggcaaucaggaaaagccugcacgaggaaaccguaaguggaaaaauagauuuaccauggguugaaacuaacaacggcgaauuuaucacagcaacucgaaaauccuuagacgcaaguuucaauuuagagaaaauaaagaaaauuaccgauacuggcauucagaaaauauugaggaauuaucuaaaagcaaaagaugacaaugccgaacuagccuucucaccagaaggaaucgaagaccucaacaaaaauaucgaaaaauauaacgauggaaaaagccaccaaccaaucgugcgcguuagaguauacgaaaaaggaaaagguagguucgcgcucggacagacaggaaacaacaucgacaaauacguccaaggaucaccuaaucucuuuuucgcaauauauaaagaugaaaaugguaagaaaucauacgaaaguauaagacuagacauagucauagaacgaaugaaacaaggauuacaagcaguacccgaaacaaauccgaacgguauaucauuauaucaaaaucuguccccgcuagaucuuguauauaucccgacagaagacgaaauagaaucaccacaccucauugacuuuacuauauugaauaaaacaagauuagaaagaauuuacaauguuaacgauuucaguggcuauacaauauacuucucacaaaauucauucgcgaaaaauaucuacccaaaagaaauggauaugacguggaacgaaaagaagcaaaaacccucagguucguucgauucaaaaacagcaaguuauaauaagaaaaguaucaaagauauauuuaucaaacuaaaaauagauagacuaggaaauauaucuaaaguuucaaauacacucuga

SEQ ID NO: 9190 - RNA, 4401 nt, Artificial Sequence
  Cas9 variant
augaagaauauucuuggauuagacuuaggaacaaauucuauaggaugggcuuuaguuaaggaagacuuugaaaacaaacaaggugaaauucuaggacuagguagccgaaucauacccaugagccaggacauacuaggagaguucggaagagguaacaguauaucucaaacagcagauagaacugguuacagaggaguacgaagauugcgggaacgucauuugcuuagacgagaaagacuacauagagugcucaauauacuaggguuucuuccaaaucauuacgcaaaggaaauagauuucaccaaacgacucgggaaauuuauaaaccacgccgaaccuaaacuaucauuugauaaagaguucauauucaaagauucauucaacgaaaugcuaaaagacuuccaacaaaaccaacccggauucaucauaaauaaacauggagaagaggcuuuaguaccauacgauuggaccauauacuaucuaagaaagaaagcacuaacucagaaaauugacaaagaagaauuagcauggauacuacuuaacuuuaaccagaaaagaggguacuaucaacucaggggcgaagaagaagaagaaaacacaaauaaauuaguugaauuuuacagucuaaaaauaauugauguuauagccgacaacgaagugaauaagaaaggggaagucugguacucucuacauuuagaaaauggauggaucuauagaagaaguucaaaaaucagucuagucgauuggaaagacaaaguacgugacuucauaguuacaacagacguaaacgaugauggaucugaaaaauuagacaaagauggagucguaaaacgcaguuucagagcaccuuccgcugaugacuggacacuacuaaagaagaaaacagagcaagacauagacaacuccaacaaaacaguaggagccuacaucuaugaaaaccuauuacuaaauccuaaacagaaaaucaaaggaaaacucgugcgaacgauagaacgaaaauuuuacaaagaugaguuaaaacaaauacuugaaaaacaaaaagaguuccaucaagaacuacaaaacgaacaacuacuccaagauuguguuagagaacuauauaaauacaaugagcaacaucaacaaaugcuagaauccaaagacuucguccauuuguuccuuaaugacauaauauuuuaccaaagaccauuaagaucucaaaaaucguuaauaucaaauugcacccuagaaaagagaguaagcagagauggaguaguuuuuccaauaaaaguuauaucgaaaucaaauccauauuaccaggaauuucgauuauuacaauggcuccaaaaccuagcaauuuaucgcaaagacgaugacguuaauguaacccaagaauuucuaaacucaauagaaaguugggaaaacuuacuucaguuuuuaaacgcuaagaaagaaauaaaacaagaacaacuaauaaaauucuuacucgaacaaaaaggauugaaagguaacagcuuaaaaacagccauacuaacauauagauggaacuacguaacagacaaaguauacccaaugaacgaaacacgcucacuaauacaagauaaacuaaagaaaguggaaaacguagcgacagauuuucucucuuuugacaaugaaauggcucuuuggcacauaauauacucaguuaacgauaaaauugaauacgaaaaagcacuagcaaaauucgcuucuaaacacaacuuagaugaaauaucuuucguugaaaguuucaagaaauuucccccauuuaaaagugauuaugggagcuucagugaaaaagcaauaaagaaauuacucccacucaugcgcuuuggaagcguauggaauaaaaauaauauugugccgaguguauuagauagaauagacaaaauacuuacuggagaauaugaugagaaaauaaaaauaagaguucgagaaaaagcagaacaauuccaacucaaccaaauugaagacuuccaaaaccugccacuaugguuagcccaauacgucguauacgaccgacauuccgaagcagaaaucgcuggaaaauggaacagcguaaaagaucuagaaaauuauuuaaaggaguucaaacaacauucauuaagaaauccaaucguagaacaaauaaucacagaaacucuaagagucgucaaggacauauggcagcaauauggaaacggaguacaaaacuucuuugaugaaauucauauagaauuaggcagagaaaugaaaaauacugcagacgaaagaaagcgcauaacaaacucaguaacagaaaacgaaaauacaaaccuucgaauaaaagcgcuucuaguagaacuaaaggaagacacaaacauagaaaacguacgaccacacucgcccaugcaacaagaaauacuaaaaaucuacgaagaaggcguauuaaacgccguagaaaacauagacgaggacauccuuaagauaaguaaaacagcccaaccuucuaaaucagaauuaaucagguauaaacuaugguuggaacaaaaauaccaauccccguauacaggcgagaugauaccacuguccagacuuuuuacgagugacuacgaaaucgagcaugugauaccacaaucacgguauuuugacgauucuuuaagcaauaaaguuauaugugaagcagccguaaauaaaagaaaggacaaccaauuagggcuugaguucaucaaaaaucaccacuccgagaaaauagaacugggaaauggacgaacagcccaaguacuugaaguagaggcuuaugaaucauuuguaaagaaaaacuacgacaaaaauagaggcaaaagaaacaaacuccuauuagaagaugugccagagaaaaugauagaaagacaacuuaacgauacucgcuacauaucaaaauucguuacacacuuauuaagcaacauagugcguaaagacgaagucaacaguaaagaugacggaauaaacucgaaaaauaucauccccgguaacggaaaaauuacgucacaauugaaacaggauuggggacucaaugacgucuggaaugaauuaauacuaccccgauuugaaagaaugaacaaccuuacuaacucgacagacuucacaucgaccaacacaaauggaaaaaucaucccaacuguuccuuuagaauauucaaaggguuuuaguaagaaaaggaucgaucauagacaucaugcauuagacgcucuaguaauagccuuagcaacuagagaucacguuaauuuauuaaauaaugaaucagcgcucccuaagaaagaucgaacaaaagaagaacaaaaauccuuuagauuugaucuacaaguaaaccuacgaaauaaagaaaaauacuuuaacguaaaagaaggcagggaaaaagagaaauuuaccaccuuuaagaaaccauggaauacgcucacacaagacacccgggacgcacuggagaauaugguagucuccuucaaacaaaaccuacgaguaauaaacaaagcaacuaacuacuacgaguccuauacagaugaaaacgguaaucuaagauuagauaaauacggaaacccaaagaaagaacuuauaagucaaaaagggaccaauugggcaauaagaaaaucucuccauaaagagacugugaguggacaaauacaucuagacagaguuaaaguaacgaaaggaaaaauaguaacggcaacaagaaaaaguuuagauagcucauucaaugaaaaaucuauagaaaguaucacagacacgggaauccagaaaauuuuaagaaacuaccuaaaagcuaaagacaacaaacccgacguagcauuuucaccagaaggaauagaggaacugaacaaaucuauaucuguauauaacgaggguaaaaaccaucaaccaauuauaaaagucagaaucuucgaacaaggaaguaaauuuccuguaggagaaacaggaaauaaaauugcaaaauucguagaagcggcuaaaggaacuaaucuauucuucgggauauaccaagacaaaacgggaaaaagaaguuacgacacaauuccauugaauuuagucauagaacgacugaaacaaggauugagcccaguuccugaaacuaacgaaaaaggacaccaacuccuauuccaucuaucaccgaacgaucuaguauacgucccuacaauagacgauaaugaacaacuggacaguaaccggguauauaaauuuacugauaguagugacaccaccuguaauuuuauaccaaguaauauaagcgcgaucauauucaauauuaauucaaaggaacaagagaaaagggguauaaacuaucccauucaaaaugaacuaggaguaggauccccacaaucuaaaaaucaaaaaucauucgacgguuuuaugauaaaagaaguaugcauuaaacuaaaaguagaucguuuagguaacauaucaaaaacuuga

SEQ ID NO: 9191 - RNA, 4416 nt, Artificial Sequence
  Cas9 variant
augugcaaauauuuuuacaucaaaaacuucaucacauuuguacucagcaaaucuauaauaccaaugaaacauauacuaggccucgaucuaggauccaauucaauaggaugggcauucguccaacaggauuuugagaacaaacaaggcaagauaauagcgaccggaucaagaauaaucccuauggaucaaggaauacuuggugauuuugagcgaggcaacaccguaucccaaacagcugaaagaacaacguaccgaagcacacggagacuacgggaaagacauuuacuaagaagagaacgucuacacagagucuuacacauacuuggauuccuccccccacacuaugacgcgcaaauagauuuuacaaaacgauacgguaaauucauagacaacgcagaacccaagauagcuuauaauaaugguaauuucauuuucaugaauucauuuaaugaaaugaucgaagauuucaaaaaacaucagccucaacuauucuacaaaaaaucaaauggugaagaaagcaaaauaccuuacgacuggaccauauauuauuuacguaagaaagcccucucacaaaaaauaacacaacaagaacucgcauggcuuauacuccauuuuaaucaaaaaagaggauacuaccaacucagaggugaagaagaaacagaaaaucccaacaaagaaguugccuuccacucucuaaaagucgucgauguagaggccgaagcuccaaauaagaaaggcgaaaucugguauacuauaaggcuagagaauggguggaucuauagacgaaccucuaaaaucccucuugacgauuggaaagggaaaacaagggacuuuauagucacaacggauuuaaacgacgacggaacaauaaaaguagauaaagaaggaaaagagaagagaucauucagagccccggacgaaaacgauuggaaucuauugaaaaaaaaaacugaacaugacauagacuucuccggaaaaacaguaggggcuuacauauacgaucacuuacuacaaaaccccaaucaaaaaauuaaagggaaacuuguacggaccauagaacguaaauauuacaaagacgaacuuaaagcaauacuagcgaaacaaauagccuuacagccagaacucuucacagaaacacugcuagcagauuguauaagagaauuauacagaaaaaaugaaacccaacaacaaaaccucuuaucuaaagauuuccuacaccuuuucguggaagauauuaucuuuuaucagcgucccuuaagaucaaaaaaaucuacaaucgcaaacuguacacuagaaaagcgcaguuacauugacaaagaaacaaaugaaagaaaagaugcaccaauuaaaguaugugcaaaaucuaacccuuauuaucaggaauuccgaguacuccaauggcuacagaaccuacgaauauaugaaauugaaacggaccgugaaguaaccgcagaauucauugaaacaccacaagacugugaggcauuauuuaauuuccuuaugagccaaaaagagauugacaauaaaggacuuuuaaaauauuuccuguuugcaaaaaauccacaaaucaaagauaaagcugccaaaucagaacucaaaaaaugguuaacuacuuacagauggaacuauguauacgacgcagcugauaauuccucaaaaaaauauccaaugaaugaaacagguuacgaacuucagcguuaucuccaaaaaguggaaggcuuaccagcuaauuuucuaacguucgacauaaccuaccaauuauggcaucuacuauauucaguaaaggacaaaguagaauuugagaaagcucuaaaaaaauuugcaaaaaaaaaacagcuagacaaaacauccuucguagauucauuuaaaaauuuuaaaccguauccaaacgaauaugguagcuucucagaaaaagcaauaaaaaaacuccuuccucuaaugcgauucgguaaccauugggauuuuaaucgaaucgacguuucgacacaaaaaagaauagaugaccucauuaacggugucgccaaugaagacauuagaaccauuauacgagagaaagccgagaaauaucaauuaaacucugaaaccugcuuccaagacuuacccuuaugguuagcacaauacguaguauauaacagacaugcggaagcaacagauaucgaaaaauggacgagcguaucagacuuggaagccuaucuagaagauuucaaacaacacagucuacgaaacccaauaguggaacaagucguaacugaaacauuaagggucguaagagacaucuggcaacaauauggaggcggacaagcaaacuucuuugacgaaauacacauagagcuaggccgagaauuaaagaaaacagcugaagaacgcaaacaauuaagugauaaaaaccaagaaaaugaaaguacuaacuuacgaauuaaaaaauuauuagccgaacucaaagaagaugcuagcauacaaaauguacguccauacucauuaguacaacaagaacuauuaaaaauauacgaagaaggaguauucucagcaacagaugaaguagaagaagauauucagaagauuagaaaaaaagcugaacccucgaaagcagaucuccagcgauauaaacuuugguuagaacaaaaauacaaaucaccauacaccggagagguaaucucauuaacuaaacuuuucacagaagaauaugaaauagaacauauuauaccacaaaguagguacuaugacgacucccuaucaaacaaagucaucugugaaucggcuguuaacaaacucaaaaccaaucaauugggauuagaguuuauucaaaaccaucacggggaaaaaguucgcauuacagccaacaaagaaguaacuauauuuacugaagaacaauauaaagaauucgucaaaaagcacuacgcaaauaacucugcgaaacaacaaaaacuauuauuaaacgaaauaccagaaaaaaugguagccagacaacuaaacgacacacgauacaucucuaaguauauaagugaaauauuaaguaaaauaguaagauccgaugaaaaagaugagggaguaaacucaaaaaauauuauaccauguacugguaaaauaacuaccgcucugaaacaagauuggggacucaacgauguauggaauaaauuaauauugccgagauuugaaagaaugaaucaacucacacaaacccaacuuuuuacaagcuacaaugacagacuacaaaaaaaccucccaacugucccaauugaauacucacaagguuuucagaaaaaacgcaucgaucacagacaucacgccauggaugcgcuaguaauagcuugcgcaacaagagaacacauaaauuacaugaauaaccaacaugcacuagauaagucaaaagauaaaaaggagaaacaacaaucaagaaucgaccuccguaccaucuuaugugaaaaaaagaauaauaacuggcaauucaaaaaaccguggucgacuuuuacgcaagaagccaaggaagcacucgaacauaucguagucagcuuuaaacaaaaucuccguguaaucaacaaggcuacaaauuauuacgaaaaaugggaagaaaaaaacggugucuuagucaaaaagaaaguaaagcaagaaggaaccaauugggcaauaagaaaaccacugcacaaagagacaguauccgguaaaauagucuuagaccgaaaaauagguaaagauaaaauccuaacagcaacacgcaaagcagucgacaucacauucaccgaaaaaaucauaaguuccauaacagauacagguauccaaaaaauccuacugaauuaccuuaaauacaagggaucaccagaaguagcauuuucgacagagggacuagaagaacuaaacaaaaacauagcucaauauaacaacggaaaaaagcaccaaccaauauacaaaguacggauauuugaagaagguucaaaauuucccuuaggcgaaacuggagccaaagcuacaaaauauguagaagcagcaaaaggcacaaaucuuuuuuuugggguguaucaagggaagggaaaaaggacauaugccacaauaccauugaacgaagugauagagcgacaaaaacaaggauuaccaucaguaccagaacgaaacgaaaaaggagaaccauuauuauuuucacuaagcccuaacgaccucguauacguaccaauggaaggagagauagcggaaacaauugacuuuaacaaccucuccaaagaacaaaaagaaagaauauauaagacaguuucauucacuggaaaucaaugcuucuucguacaagaggcaguagcuacaccaauagucaacaaaauggaauacucuccacuaaacaaaauggaaagggacauauuaggcaccaugauuaaagagguaugcauaaaacucaaaguagaucgacuaggaaauauaacaaaagcuuga

SEQ ID NO: 9192 - RNA, 4416 nt, Artificial Sequence
  Cas9 variant
augggauauaaagcaccacgaaacgacaaaggcgaaauagacuauggggucggccuugaucuaggaaauggauccguaggauggguugccauggacaaagauuaucaccuaauaagagcaagaggacacgaauuaauaggggccagacuauuugacccagcuaauucagcggaaaaucgacgagaaucacgaacuacacgucgaagauuaagcagacgacguuggagacuacgaauguuagacaguuuauuugcaucagaauuagcuaaaauagauccuaacuucuuagcaagaagaaaguacaguugggugcauccaaaagaugaacaaaaccacgagaauugguaugggaguauaauauucgguucuaaagaacaagauaagcaauuuuauaaggauuaucccacaauauaucaccuacgaaagaaauuaacggaagauacggagagacaugauauacgggaaauauauguagcuauacaucacauuguaaaauacagaggacauuuccuaagagaaggagaaauaaacagcgagaaucuauuugacccagaaggauuugucgaguuaauuaaagacguuauaaaguuaaacaauucauacgaugaaucaacaccgauuuucgaagcaaguccugcugauguuucagaagcacuacuaaaugaacauacaucaagaucgggaagaauagaagauacucuugacaagcuagauuuuucaguaagcagaguugauaaacacgaacuaaaagguaugagggacgcggcuaaagcagucauaggagcaauaguaggaaauacagcagacuucagcaaaaucuuuaaccuagacaaccuagauaaagacucuaaagacaaccuaaaacuaaaauuugccgacucgaauuucgaugaaaaauauggagguguaguaggaagcggacuacuagaugaaacucaaauagagcuaguugaccggauucacgcaguuuaugacgcaguugcauugaaaggaauccuaggagaugcacauacaaucucagaagcuaagguagaaaguuaugaaaaacaucgaaagaauuggaaauuaaucaaagaagaacuaagaacaaaagaaaacaaagacgaaguugaucucugguacggagaucuaucuggucgucaauacaaaaauccaccugacccagaaaaagggcccgacgaaggaucaaagaaagacaguccaaucagagacagugaccaaaaacagaaucuaaucaagaaagcgaaugauuauuuuacggaacuaauugacgauucacaauuaucagaagaacagaaaaauugucugaaaaaugacaucaauaacggacaauuauucccaguacaaagaaguagugauaaugggguaauaccuuaccaaauacaccuaaaugaauugagaagaauaauagaaaaucaaaaacaauacuacccauuuuuagcagaaacauucauacgaaaaacagcagaaggcaaaaguuaugaagagaacaaaauaguggcacuauuaaaauucagagucccguauuauguuggaccauugguuaguaaagaagauauggaagaacauaguucuggaaauagugcuuaucacuggauggccagaaacccagguagaggagaagcaauaacaccuuggaacuuugaugaaguaguagauaaagaugaaucuggugcacguuuuaucaguagacucacgggaacagacacuuauuugcuuggagaaccaacgcuaccccaacauucauuacucuacgaggaguacaugguccuuucagaacuuaacaauguaagguugaauguuagacaaggaaaccauuggagcgauaaaaaucgacaaagguuaagcuacaaacagaaagaguucuuaauagaaaacuuauuuaaagaacauaaaacagugacuagaaaaagggcagaagauugucuaaguucgaugggaugcggagaaguccaauuauuuggauuaagcgaugaaaagaaauuugccaguucacuaagcucauauauuaccuuaaagaaaaucuuagggaaagcauucguggacgauucaggaaauagugcuauacuagaaagaauuaucgaaguccaaacaguguuugaggacagggaaccacuaacgcaucagcuaagucucauagauagccuaacaguugaacaaagaaaacaauuggcgaaaauacauuacacuggauggggaaaacuuucacguaaacuucuuacaagcaagaaaggcagcuauaaaauucacagucagaaugaaauuaugagaacacaacacagcaucauugacauaaugcgcggagauagucuaaaccuaauagagauaauuagggacaagaaaauagguaucggagaauggauagauaaugagaauuuagauagagaaacuggagaaagugacguaucacgacuggaaagcguauucgaaggaauaguaaugucuccucggguaaaaagaggaguaguccaagcaguaagggucauugacgauuuggcaaaagcaauaggaaauccuccacaaagaauuuuuauagaaauggcugaugaaguacaggcuucucaaagaacaguaagcagauuaucacguuugaaagcgcuauacggaucgcccaguuuacaaaaagaauuuaaugaccuaaaagauuugaggaaaucauugaaugaaacgaaagacgcagaucuccaggaagaccgauuauaccuauauuacauacaacuaggaaaagacuuauauaccgguaaagagaucucaauugacucucugucuucagccuacgauaucgaccauauuguaccccaagcccuuacccaagaugacuccauugacaauagagucuuaguuagucgaaaagagaaugccagaaaaacagauagcuaucuuuacaccccggaucuaaucaaaaacaugcgaccucuauggggaaaacuacuggcagcaggauuaaugucacaaaagaaauacgaugcacuuacaaggguagaugauuucaaagaucgagagaaacaacgcuucguacaacgaucccuaguagaaacuagacaaauaaugaaaaauguaucaacaauuuuaagaacauauuacggggaagauaccaauguuguaacacuaaaaaguucaauaacacaugauaugagaaaauaccuagguuuuccuuacaaaaauagagacaucaacgacuaucaccacgcgcaagaugcauuguguauaucagcagcuggucaauucaugcuaaauaggcauuuuguaucaggaggagaaguuacugauggagccaguaacgccuauaacauguauuuagcagaauaucuacaagaauuuagagacgccaaagcaagaggugaaagaaaacgaagcaccgcuuuuggcuucgugguuggaagcaugaguucuaaagaugacgaaaagaggaccgaucaucgaacgggugagauaguuuggucagagacuaaugcagaauacuugcgcaaaguuaugaacuauaagaaaauguugauaacacaaaaagugggggaugucaaaacccgagcucuuuaugaugagacucgauacggccacaaagaaagcuccgcuaaaagcaucaaauuugauaauuugcgucgagacacuucacuauaugggggauuuaguggggccagcacagcuuauaugauguuaguagaauacaagaaaaagaauaaacuuguauccauaaccgcucaggaggccucccuacuagcagucgcagaccagaaaaacgacacaguuagcgugauggauggaauuuuagcaucgcauggauuaagcggggcaaaaauauuauuaccaaaaauuguaaccggacaauuauuagacuacucagacgcguuaguaacacuucaaucagcaucugaguuaaacacagcacgacaaauguggcuaccucgaaacgauuauaacgacaucgacaucauuuuaaagaguaaagauauugaagaugcagcucauaaauuaggguacgacucagacacagugcacguuuuaagacgaauccaaaaacuauucgaagcgguauuuagaguagcugagucccaauucccauuacaucaacuaucaaaagaccaacaagaagagauucuacgagauccccagaacuaugguuucggaucugcaguuaaauuguuaggcggccucuuaaaggccuuacaugcaaaugcagaaaauacgaaucuagcagggcucguaaaaguauugcacggggauaaagaauauagugaugacgguaaagcaaaagaauuuaagaaauucggauuuucaccaagauggagacgaauaucaaaucccacugguuuuacauuauccgacucagauacuuuuauauaucagucccccagcggcauauuugaacaaagaguuacaguaaaagaacugaaggagaaagcugauaaacaaaaauga

SEQ ID NO: 9193 - RNA, 4422 nt, Artificial Sequence
  Cas9 variant
augaaaaauauacuuggacucgaccuagguacuaacagcauaggaugggcacuuaucgaaaaagacacagaccaaaaaaaugggaacauacucggcacggguagccgaauaauacccaugagccaagauauuaaagaugaauucgguaaaggcaacagcauaucccaaacagcugauagaacaaaauucagaagcguaagaagacuacgcgaacgccauuuacuaagaagagagcggcuucaucgcguucucaauguccuaggauuccuuccaaaacauuaugcagaucaaaucgacuucaaaaaaagacucggaaaacuuguaaacgaaacagaaccaaaacuuguauaugacaauaaaaauuucauauucaaaaagucauuugaggcaauguuaucagauuucaaccaacaccaaccucugcuauuagcagacgguaaaaagguacccuucgauuggacaauauacuacuuaagaaaaaaagcacugacagaaaaaaucgaaaaagaggagcuggccuggcuaauucugaauuucaaccagaaacgaggauacuaucaauuacguggagaggaagaagaagaaaacccaaacaaaaugguagcauuucauucacuaaaaauaguugaaguaauagccgaugaaucgcaaaaagguaaagcagagaccugguauucccucauuuuagaaaauggauggauuuauagaagauccucaaaaaccccacuuuaugauuggaagggcaaacagcgagauuuuauugucaccaccgaucuaaacgacgacggaaguauaaaaacagauaaggaaggcuuggaaaaacgauccuuuagagcaccuguugaagaugacuggacacuagucaaaaaaaaaacugaacaagaaauaaaucgaagucauaagacaguaggcacauauauauacgaaaaccuauuacaagauccaaaacaaaaaauaaaaggcaaauuagugaggaccaucgaaagggaguuuuacaaagacgaauuaaaaaugauucuaaaaaaucaacaaaaauuucacccggaacuaaacgacgaacaucucuauauaaauuguguccgcgagcuauauagaaauaaucaagcucaucaaacaauacugaguaaaaaagauuuuguacaucuuuucauagacgacauuaucuuuuaucaaaggccacuacggucccaaaaaucaucaauaucuaacugcacauuagaauuuagaaaauauaaaaacgaaaacggaaccgaccaaacagauuaccuaaaagccauuccaaaaucacacccacuguuucaagaauucaggcuauggcaauggauuuauaacuugggcauuuaccaaaaagaagaugauacaaaugucacagacgaacuuaucaaaaauauugacggguaucaagacuuauuugacuuccugaacaauaaaaaagagauuagacaagauauacuaauuaaauuucuaguugaacaaacaggacucaaagggaagccccugucuucaguaguagcaaaauaucgauggaacuuugucgaagacaagaucuacccaugcaaugaaacagguacgcaaauacggaccaggcuagcaaaaguggagaacacaccagaagauuuccuaacagccgaaacugaaauuaaacucuggcauauaauauacagugugaacgauaaagcugauuaugaaaaagcacucaaaacauuugcagaaaaacauaaucuagacacucacuccuucguagaaaacuucaaaaaauuuccuccauuuaaaucagaguacggcucauuuucagaaaaagcaauaaaaaaacugcuaccccucauaagacuuggcaaauacugguccugggaaaacauugauaaaaaaacucaagagagaauagaaaaaaucuuaacaggagaauucgaugaggcgauuaagucaagaguuagagauaaagcaauacauuugaccgaagaagaccauuuccaaggccugcaguugugguuagcauccuaugugguauauggacgacacucagaagcggacaauuuagauaaauggcacaccguggcagacuuagaagacuauuuagcugaguuucgacaacacucacuuagaaauccaauugucgaacaaguaaucaccgaaacacuucgugucgucaaagauauauggcuccaauauggucagggcgcaaaggauuuuuucagcgaaauacauauugaauuagcucgggagaugaaaaacaccggugaugaacgaaaaagauugacuucccucguaaccgacaaugagaauacaaaccuaaggauaaaaguacuacugucagaacuacugaacgauggaaacguagaaaacguccgcccguauucaccuaugcaacaagaagcuuuaaaaaucuuugaagacggaguccuaaacucagauauagaaaucgaggacgauauucuaaaaauaagcaaaauggcucaaccgacaaauacagaacugaaaagauauaaauuauggcuagaacagaaauauagaagcccauauacuggacagauaauaccacugaaccgacuauuuacugcagauuacgaaauagaacacauuauaccacaaucaagauuuuucgacgacucguuuuccaacaaaauaauaugcgaaagcgccguaaaucaauuaaaagacaagcaauuaggauuagaauucaucaaaaaucauaguggaacaauaguuaaacucgggaugggaaagacugcaaaaauauuagauguagaaucauauaacgaauuugucaaaggaaacuauacaaaaaacauuagcaaaagaaauaaauuaauguuagaagaaauaccagacaaaaugauagaacgucaacucaacgauaccagguauaucucaaaauuuauaaucagcgcccuaaguaacaucguaagaagugaaaguaaugacgauggauucaacucaaaaaacguacuuccaggaaauggaaaaauuaccucuagacuuaaacaagauugggguaugaacgacauuuggaaugaacuaauauuaccgagauuugagcgcaugaauaaaauaacagacagcgcaguauucaccgcauggaaugaaaauaaccagaaauuucucccaauagugcccuuggaauucagcaaaggauuccaaaagaaacgaaucgaccaccggcaucaugcucuggacgcccuaguaaucgcagcaucaacgagagaacacauaaauuuacuaaauaacgaacacgcaaaaucagauaaaagauucgacuuaaacagaaaguuaagaaaauuugaaaagguagcuuacaaugacccaaaaacaggaaaaagaauagaaaaagagguuccaacaauuuuucucaaaccaugggaaacuuucacaguugaugcuaaaaauaguuuagaaucuauaauuguaucauucaaacaaaaucuuagagugauaaaucgagcaacaaauuacagugaaucuuauaaugacgaaaacggcgcccuacgauuaggcaaagacggaaacccccuaaaagaaaaaauaaaacaaucgaaaggagauucuugggcaauccguaaacccaugcacaaagauuuugucuacggaaagguacauuuacaaaauguaaaguuacccaaggauaaauucauuacugcaaucagaaaaucacuagauguaaccuucgaucuaaagcgaauagaaacaauaacugauaccgguauacaaaaaaucuuaaaaaacuaccugcauucaaaagaaaauaaaguugaacuagccuucucaccagaaggcauugaagauaugaaucaacacauagaaagauacaacgaugguaagaagcaucaaccuauucacaaaguacguguauucgaaauaggcagccguuucuccuuaggcgaaucugggaacaaaaaaaccaaauucguagaggcggcaaaaggaacuaacuuauuuuuugcuguuuaucaagaugauaauaaaggaaaacgaaauuacgaaacaauaccucucaacauuguaauagaacgacaaaaauuaggcuuacauucuguaccaacagaagaugcaaaaggagggaaacuacuauuucaccuaagccccaaugacaugguauacgucccaacaagcgaagaauuagaagauaaucucgccucaguaaauauaaaaagauuaaauacagcacaacgaaaaagaauauauaaaguagagaaagcgagcggaguagaaugcuacuuuauaagacaagacaucgcauacuugauaaaaaauuacgacgcaaaaacuaaaaucggagaacuugaaucacaaaacaaauuacaaacaaccaugacagacgauagacuaaaaauaacagacgucuguguaaaacugaacauagauagacuaggaaguaucgcggaaacauuucuuggaaaucaauacggugcaagcaaaaaaacauga

SEQ ID NO: 9194 - RNA, 4422 nt, Artificial Sequence
  Cas9 variant
auggccaaaauauuaggauuggauuugggcaccaacuccauaggcugggccguaguagaacgagaaaacauugauuucaguuugaucgauaaagggguacggauauucucagaaggcgucaaaucugaaaaaggaauagaaagcucccgggcggcugaaagaacagguuauagaagcgcacgaaaaauaaaauauagacguaaauuacggaaauaugaaacucuaaaagugcucucucugaaucgaaugugcccacuaucaauagaagaaguagaagaauggaagaaaaguggauucaaagacuacccccuuaauccagaauuucugaaauggcuuuccacugacgaagaaucaaauguaaaccccuacuucuucagagaccgagcuaguaaacauaaaguaagccucuuugaacucggcagagcauucuaucauauugcacaaagacgaggcuuccuaaguaacaggcuagaccaaucagcagaaggaauauuagaagaacacugcccuaaaauugaagcaauaguugaagaccuuaucucaaucgaugaaauaagcacgaacaucacagacuacuuuuucgaaacaggaaucuuagauagcaaugagaaaaaugguuacgcgaaagaucuagaugaaggugauaaaaagcuaguaucauuauacaaaagccuacuagcuauccucaagaaaaacgaauccgauuuugaaaacugcaaaucagaaauaaucgaacgacuaaacaagaaagacguacuagggaaaguaaaagguaaaauuaaagauauaucacaagccaugcucgaugguaauuauaaaacacuaggacaauauuuuuacucccuuuauaguaaagagaaaauaagaaaccaauacacaagcagggaagaacauuaucuuagcgaauuuauaacuauauguaaaguucaagguauagaccaaauuaaugaggaagagaaaauaaacgaaaagaaauucgauggcuuagccaaagauuuguauaaagcuaucuucuuucaaaggccucuaaaaucucaaaaaggauuaauaggaaaaugcucuuucgagaaaaguaaaaguagaugugcaauaucccacccagauuuugaagaauauagaauguggaccuaccuaaauacuauaaaaauagggacgcaaucagacaagaaauuacgauuucuuacacaagacgaaaaauuaaaauuaguuccaaaauuuuacaggaaaaacgauuuuaauuucgauguacuugcuaaagaauugauugaaaaaggaagcucuuucgguuucuauaaaucaucuaagaaaaacgauuucuuuuacugguucaauuacaaaccaacagacacuguggcggccugucaagucgccgcaucacucaaaaacgcuauaggagaagacuggaaaaccaaaucauucaaauaccaaacaaucaauagcaacaaagaacaaguaagccgaacagucgauuacaaagaucuauggcaucuacuuacaguagcaaccagcgacguauaucuauacgaauuugcaauagauaaacuugggcuggacgagaaaaacgcuaaagcauucagcaaaacgaaacucaagaaagacuucgcaagucuuucacucucagcaauaaauaaaauucuuccauacuuaaaagaaggacuucucuauucgcaugcaguauucguggccaauauagaaaacauaguugaugaaaauauauggaaagaugaaaaacagagagacuacauaaaaacccaaauaucggaaauaauagaaaacuacacauuagaaaaaucucguuuugaaaucauaaacggcuuauuaaaagaauauaaaagcgaaaacgaggauggcaaaagagucuacuauagcaaagaagccgaacagagcuucgaaaaugaucucaaaaagaaauuaguacuauuuuacaaaaguaacgaaauagaaaacaaagaacaacaagaaacaauuuucaacgaacuacuaccuauauucauacaacaacucaaagacuacgaauuuauaaaaauacaacgucucgaccaaaaaguauugaucuuccuuaaaggcaaaaacgagacaggacaaauauuuuguacagaagaaaaaggaacagcugaagaaaaagagaagaaaaucaaaaauagacuaaagaaauuauaccaccccucagacauagaaaaauuuaaaaagaaaauaaucaaagaugaguucgguaaugaaaagauaguguuaggaucaccauugaccccaucuauuaaaaauccgauggcaaugagggcacuccaucaacucaggaaaguucugaacgcacuuauuuuggaaggccaaauugaugagaaaacaaucauccacauugaaauggcuagagaacuaaaugacgcaaauaaacgaaaagguauacaagauuaccaaaacgauaacaagaaauuuagagaagacgcaauaaaagaaaucaagaaacuauacuuugaagauugcaagaaagaaguggaacccaccgaagacgauauacuuagguaccaacuauggauggaacaaaauagaucagaaauauaugaagaagggaaaaauauuuccauaugugauauaauaggaagcaauccagcauacgauaucgaacauacaauuccuagaucucgaagucaagacaacagccaaaugaauaaaacauuguguagucaacgcuuuaaucgcgaaguaaagaaacaaucuaugccaauagaauuaaauaaucauuuagaaauucuaccaagaauagcacacuggaaagaagaagcggauaaucuuaccagagaaauugaaauaauaucacgcaguauaaaagcugcagcgacaaaagaaauaaaagacaagaaaauccgaagaaggcauuaccuaaccuuaaaacgagacuacuuacaaggcaaauaugaucguuucauaugggaagaaccaaaaguggguuuuaaaaacagccaaauaccggacacagguauaauaacgaaauaugcacaagcauaucugaaauccuacuucaagaaaguagaaucaguaaaaggcggcaugguagcggaauuucgaaaaauauggggaauccaagaaucuuuuauagacgaaaacggaaugaaacacuacaaaguuaaagacagaaguaaacauacucaccauacgauagaugcaaucacaauagcauguaugacaaaagaaaaauacgacguauuagcacacgcauggacucuagaagaucaacagaacaagaaagaagcaagaaguaucaucgaagcaucaaaaccauggaaaaccuucaaagaagauuuauuaaaaaucgaagaagaaauccucguaucacauuacacaccagauaaugucaagaaacaagcgaagaaaauaguaaggguacgagguaagaaacaauuuguggcagaaguugaaagagacgucaacggaaaagcgguacccaagaaagcugcaucaggaaaaacaauauacaaacuagacggagaaggaaagaaauuaccaagacuacaacaaggggacaccauccgugguucauuacaucaagacucaaucuacggggcaaucaaaaaccccuuaaauacggaugaaauaaaauacgugauacgaaaagacuuagaaucgauaaaaggcagcgauguggagucaaucguagaugaaguagucaaagaaaagauaaaggaagcaauagccaauaagguacucuuacuaagcucgaaugcccaacagaaaaacaaauuaguaggaaccguuuggaugaacgaagagaaaaggauagccauaaacaaaguaagaauauacgcuaauagugucaagaacccguuacacaucaaagaacauucacuacuaagcaaaucaaaacacguucacaaacagaagguauacgggcagaaugacgaaaauuacgcaauggcuauuuacgaauuagacggaaaaagagacuucgaacuuauaaacaucuucaaucuggcaaaguuaauaaaacaaggacaagguuucuaucccuuacauaagaagaaagagauaaaagggaaaauaguauucguacccauagagaaacgaaauaagagggauguuguucuaaaacgaggccaacaggugguauucuacgacaaagaaguagaaaacccuaaagauauaagcgaaauaguggauuucaaaggaagaauauauauaauugaaggguugucaauccaaagaauaguuagaccaucaggaaaaguugaugaauauggaguaauaauguuacguuauuucaaggaagcaagaaaagcagacgauaucaaacaggacaacuucaaaccagacgguguauuuaaacuaggcgaaaauaaacccacacgaaaaaugaaccauaaucaauuuacagcauuuguagaaggcauagacuucaaaguacugccuuccggcaaauucgagaaaauauga

SEQ ID NO: 9195 - RNA, 4425 nt, Artificial Sequence
  Cas9 variant
augaaaaagauccucgguuuagaccucgguacaaauucgauagggugggcccucauagaaagcgacuucgaaaaaaaacaaggaaagauuaauggacucggcagcagaauaauaccaaugagccaagauauacuagguaaauucgauucagggguuaguauuucucaaacugcagaaaggaccagcuaucguggaguaaggcgccuaaaccagagaaauuuacugagaagggaacggcuacacagaguccuaaacauucuagacuuccugccuaaacacuauagcaaugcaauagacuucgaaaaaaaacuaggacaauucaaagaaaauguagaggaaaaacugaacuacgccaaaaaucaaauaggacgacaugaauucauuuucauggacucauuuaaagagaugguaaaggaauucaaacaaacucaaccacaacuauucuauaaaagagaaaauggcauagaaacuaagaucccguaugacuggacauuauacuaccuuagaaaaaaagccuuaagccaaaaaauuaagaaagaagaguuagccuggaucaucuuaaacuucaaccaaaaaagagguuauuaucaauugaggggagaagauguccuggaugaaaguaaaaucgaagacuucuauagucucaaaguuguagaaguccaggaaacagaagauaaaaaugccagaggaacaugguauaauguaauauuagaaaacgacuggguuuauaaaagacaaaguaaagaaucauuagacaacuggaucggaaaaaacaaggaauuuauuguaacaacaaauaaagagaaagacggcuccuuaaaacuagacaaagcagguaauguaaaacgaaacuuuagagcaguggauagugagaaagauuggauagcaaucaaaaaaaaaacagagcaggacguugaaauuucaaaacacacagucggccaauacauuuacgaaacgcuccuacaaaacgcuaaacaaaaaauuaaaggaaaacuagugaaaacaaucgaacgcaaauucuauaaagaggaauuuaucaaaauaauaaaagaacagcucaaacaccaucccgaacugcaaucaaaaacccuauacgaaacuuguauacaagaauuauaccccagaaacgaagcgcaucaaaacaauauaaagucaaaaggauucgaauauuuauucacggaugauauaaucuuuuaccaacguccgcuaaagucaaaaaagucgaccauaagugguugucaauaugaaacaaggcucuucaaaaaaaccguacuaaacaaaguaacaaacaaagagaaugaaauuuggcaaaaagaaccacugaaagcuauaucaaagucacaccccuuauuccaagaauucagacuauggcaauuucucaaaaaucucaaaauauaccaaaaagaggaugucaaaggaaaccuaaucgaccacgauauuacaucggauuuauugaaaacagaagcugacuggguagaacucuuugacuuucuaaacauuaaaaaagagaucgaacaaaaacaaauaauacaauuuuuuauaaacaacaaacaaauagaaaaagguaaaaaaaauaauuacagauggaacuauguagaggauaaaaaauacccaugcaacgaaacaaaaucgcaacuaauuucacgacucaagaaaguuaagaaucucgacuuaaaucuuuucuuuaccuccgaaacagaacuaaaauuauggcauauaauauacagcgugaaagauaaaauacaauacgaaaaagcaauaaaaaauuucgcaauuaaaaauaacauagacauagauagcuuuguugaaaauuucaaaagauucccuccauucaaaaaugaauaugcagccuauagugaaaaagcuauaaaacgauuauuaccucuuaugcggaugggggaauacuggaaugagagcgaaaucaaacaagaaguaaaagacagagcauacaguaucauagaacgccuuaaaggaauagacuucaauaaagauaaaaucgaugagaaaauuacagacgacgacauaaaaaagcaacuccucaagaguuucauagauuuuaaagacaaaaacccacuaaaaggccugaauacguaccaagcaugcuaucuagucuacaaucgacacuccgaaguuaacaguauagccuauuggaagaguccagaugacauuaauaaauauuuggaaggauucaaacaacauagucuucgaaauccaaucguagaacaagugguaacugaaacacuuagaaccguacgagauauauggcaauacuacggaaaaggcaaagcaagcuuuuucaaugaaauacaugucgaauuagggcgagaaaugaaaaacccagcuuauaaaagaaaagcaucaacaaaccggguaacugaaaaugagaacacuaaccaccgcaucaaagaaaucuuaaaagaauugcaaaaugaagguguucaagaaguuaaaucauauucacgcaaucaacaagaaauauuaaaaauauaugaagaagguaucuaccaaaguauagacguaguagaugaugccauagaaaaaauaagaaagaauucuuccccaacaaaggcagaaaucaucaaauacaaacuaugguuagaacaaggauauacaucgccguacacuggaaaaacaauccccaugucuaaguuauuuacaacagauuaccaaauugaacacauaauaccccaaucauuauauuucgacaauagccucaguaacaaaauuaucugcgagucagaagugaaccaacuaaaggauaaucaaaccgcauacgaauuuaucaaaaaacauggaacagaaaaagucagcuugggaaagaacaaaacggucgaaaucuucacacuagaacaauacgaaaaacacuguaaccaauacuucaaaaaaaacaaaaacaaacuaaaaaaacuauuaagugaagaaauaccggaaggauucauuaauagacaauugaacgacagcagauacauaagcaaauucauaaagggccuacuaggcaaucugguaagggaggaagaugagcaagaagucacuacaaaacacauagucccaguaacuggagccauaacaagcaaacuuaaacaggacugggguuuaaacgacaaauggaacgaacuagucgcuuccagauuccaacgacuaaauacgaugacaaacucaaauaauuucggauauugggacacaaaaaucaaugcguuucgaguacaagugccagacgaaauuucaaaaggcuucuccaaaaaacgaauagaccauagacaccacgcauuagacgcuuuaguaauagcauguugcacucgcaaccacaucaauuacuuaaacgccuugaacgccgaaaaaaaaaacuauggacuaagagaccuucuccucauaaaaaacgacaagaaccauuacaccaaauuuuucaaacauccuugggacggauucccagucgaagcaaaaagcguacucgaaaaaacaaucaucucauuuaagcaaaauacucgaguaauaaacaagacaaacaauaaaacauggcagugggcugaaaaagaagggcaauuaaaaaaaguacuuguaaaacaaacgaaaggagacaacugggccaucagaaaacccaugcacaaagaaacuguauccggcaaauuaaacauaccuacaccaaaaggcaaaauagcuacugccucuagagucucacuuucggaaauaaaaacccgaaaacaauuggauaaaauaacggacauaaguauucaaaaaaucuuggaaaggcauuugaacaacuauuuagacgauaaaggaaaggaaaaauuugaucuagcauuuaacgcagacggaguagaggaacugaacaaaaauauaaaaguauuaaacaaaggaaaaaaccaccaaccuauuuauaaaguaaggcuauacgaaauaggaucgcgauucaaaguaggaaacagcggaaacaagaaggauaaguacgucgaagcagcaaaaggaaccaaccuauuuuuugcaauauacuugaaugagaaagacaaaaaacgcguuuacgaaacgauaccccuaaacgaagucauagaacaccaaaaacagguaucaaaccuuccuaaaaacgaaagaacgccaguacccgucaaucauacaaaaggaaaauuccuauucagucuaucaccaaaugaccucguauauguaccaacagacgaggaaauugauaacccaagccuaguaaacuuuaacaaccucaacaaaaaacaaguugaaaaaauauacaaaacagucaguugcagcacauaccaauguuuuuucgugcacaacacuauaucaaaaccuauacaaaauaaaguagaauucucggcacuaaacaaaauggaaaaauccauugaugguauaaugauaaaggauagaugcuggaaacucaaaauggacaggcuaggaaacauaaucucaguaauacgcuga

SEQ ID NO: 9196 - RNA, 4443 nt, Artificial Sequence
  Cas9 variant
augaaaacaauacuaggacuagaucuuggcacaaacuccaucggcugggccaaaguuuguguagacaacgauggaaauuaccucagagauauaaaacuaggcagcagaauuauucccaugagucaagauacacucgggaauuuugauaaaggaguaacugauucuccaacagcugcacgaacagguuuuaggggaguacggagaauccgagaacgagcuuuacaacgaagagaacgucuacaucgaguauuacaugugaugaaauuucuuccuccacauuaugaaaacgccauaggauggaacagagaagaagcaacgacauauggcaaauuucuaaaccauggagagccaaaacuggcaugggaaaaacaagaagacggcagcaugagguuucuauuuauggauaguuuucaugagaugauggcugacuucgccgaaucgcagccggguuuaguagccggagguaaaaaaauaccacuagacuggacccuauacuaccugcggaaaaaggcccuuacacaagcuauccgaaaggaagaacuugcauggauacuacuaaacuucaaccaaaaacgaggcuacuaccaauugagaggcgaggaagacgaggaaaacccggcaaaaagagaagaauaucacgaguuaaaagugguauccgucgaagcagccgaagaaggcaaaggcgguaacacuugguacaacguuacauuagaaaauggauggaucuauagacgccaguccaaaguggaauuacacgauugggugggaaaaacaagacaauuuaucguuacaacggaguacgaaaaggacggcguaacaauuaaaaaagacaaaaacggagaaguaaaaagaucuuuuagagcaccaagcgaagaugacuggggacugagaaaaaaaagaacggaaagcuuauuagaggauucagguaaaacgguuggagccuucauuuacgaccacauccuaucagaaccaaccgauaagaucagaggaaacuuuauaagaacaauagaaagaaaauauuacaaaaaagagcuugaagccauauuacuugaacaaacuaagcaucacaaagaacuuaaagaucagaauacauuaaucgccugcauaaaagaacuuuaucaaucuaacaaaccucaucaagacucucucaugaagaaagauaugacauacuugcuaauaaccgaucucauauucuaucaaagaccacuaaagucaaaaaaaagccuaauagcagacugcccguaugaauacuaugaguacacgaucaaagaaacaggagaaauaaagagacaagggaucaaaugcauagcuaaaucaaacccguauuaucaagaauuuagacucuggcaauucauuauaaaccucagacuauucgaucgcacggaugauaaggagguaacaucagaauaucuaucaucaauggaagacuauacaaagcucuuuacauacuuaaaugauagaaaagauauaaaucaagaaacguuguuaaaagauuucuuuaaacaaaaaaaaguaaaaaugggaauggaaaaagaauucccaauaagauggaauuauauugaagauaaagaaaagaaauauccaugcaacgaaacaagacacgaacuuuuagcagcucuagacaaagccggaauugaccacaguuggcuagacgacaaagagagauucuauagguuauggcaccuauuauauagcguagaaaguaaagaagaagcugaaggugcacuuagaaaauuaaaagauaacgacgacuuugucaacgccuuucuuaaaguaaaaccauuuaaaaaagacuauggcgccuacagcgaaaaagcuguuaaaaaacucuuagcaauuaugagaauggggggacuguggaaugaaacggacauaugcgaacaaacgagaaacagaauacaauccauaauaaaaggagaaauagacgagaaaauaaaagaaaggaugggaagaacguucugccaacuaucagacuuccaaggccucccagaauggcuugcauguuaugugguuuauggcagacacagugaagcaacagacauccaaagauggacaaaaccagaaaauuuaauggcguauauaaacggauuuaaacaacacucgcuacgaaauccaaucguugagcaaugcauacuugaaacauuaagaacuguucaugacauauggaaagaagcaggacauauagaugaaauacacguagaauuaggucgcaguaugaaaaguacagcugaccaacgagcccgaaugucaaagucaauauuacaaaaugaaaacacuaaucugaggauuaagucacuauuaauggaacuuaaaaaugcaaaagaaauugaaaacguuaggcccuacagucccaugcaacaggaaauacuaagaaucuaugaagaaggcgcccuacaagaauuaaccaaggaagaugcacaauacccagagauaagcaaaauaagccagauggcgcaaccaucagcaaaagaacuacuaaaauaccgauuguggcuagaacagaaguauuguaguccauacacaggaaaaccaauaucacuaucuaaauuauucaccagugccuaccaaauagaacauauaauaccgcaauccagguacuucgaugauaguuucacaaauaaaguaauaugugaaacagagguaaaccaacuaaagucaaacaugcucggcuacgaauuuauuaaaaagcauucgggagaaaucguacacuguacaacaauaggugaugucaagauauuagaugcaaaagaauauuauaacuuuguaaccgaacauuacgcaaauaauagaagaaaaaaagaaaaauuguuauuagaagauauaccccaagaauuuuugaacagacaaaugaaugauucucgauauauaucaaaaaaaguaauggcaauacuaagcaauauaguacgagaagaggaugaacaagaaacgaacucaaaauucgucguuagcugcucaggcggcauaacggauagacuaaaacaagacugggguuuaaacgacgucuggaacagcauagucuacccaagauuugaaagauuaaauaaguugacccaaacagaagcuuucgggcgaugggaaaacaaagaaggcaaacaaguguuucagacaagucucccccuggaacugcaaaggggauucucaaaaaaaagaaucgaccaucgucaccacgccauggaugcauuggucauagcgugugccagucgaaauaucauaaauuaucuaaauaacgaguccgcuaaaagccaagaacaacgcgaagauuugcgaaaaaaacucugugauaaaaauagaauaauaagaaaaccaugggaaacauuuacacaggacgcuagaacagcauuagaagacguaguuguaucauuuaaaaauuacguacgggucauuaauaaagcaaccaacuacuaugaaaaauacgacgaaagcggaaaaaaaggcauggccgaacaaaaaggucaagacaugugggcaauaagaaaaccaaugcauaaagaaacuguuuucggacaagucaaccuacguaggaagguaacggucaaauugaaagacgcacuagaaaauauuccagccaucugcgauaaagcucuucgagauuacgugaaugaucuaauagccaaaaaauuuaauacaaaacaaauguuagcgcauuuuaaaaguauaaauuaccgacuuaacaugaaaagcguaaauaaaguaggaauaugggucuucucagaugaaaaagaacccauggucgcaacaagaaaagcuauagauauaucauucgaugccaaacggauugacacaauaacagacaccgguauccagcaaauauuguguaaauaccuaaaaucuaagggcaacgauccaaaugucgcauuuacaccagaaggaaucgcugaaaugaauaaacacauuauagacuauaacaacggaaaacaacaucaaccuauacuaaaagucagaguauccgaacccaaaggagcaaaguaucaaguaggagaaaccggaaacaaaaccaaaaaauuuguagaagcacaaaaaggaacuaaccuauacuuugcaauuuacgaggauaaagaugguaaccgaaguuacaacacaauaccacuaaaugaggucgccgaaaggcugaaacaagguuuaagcccaguaccagaaaaaaaugaaaaaggaauaucacuaaaauuuuacuuaucaccaaacgaccuaguauauguaccaacggaagaagaaaaacuaucaaacgagugcaaacucucaaaagaaaggaucuauaagaugguuucuaguacauccaacgagugucacuucauacccuauacuaccgcuaaaccgauuuacgauaaauucgaauacgaagcgaagaauaaaaugggucgagcccuaacuggcgaaaugauaaaagcagucugcuggaagcuagaaguagaccgauuaggaaacauacuaaagaucauaaaauga

SEQ ID NO: 9197 - RNA, 4452 nt, Artificial Sequence
  Cas9 variant
augaaaaccauccuaggacucgaccuugggacuaauaguauagguugggcaaaaaucucaauagacgacaacggaaauuauuuaagagauauucaaaugggaucaagaaucauaccuaugagucaagacguguuagguaacuucgacucaggaguaaccgaaucacaaacagccguacgaacaggauucagaggccucagacgaauacgagaaagaagucuacuaaggagagagaggcuccacaggguacuccacgucaugggauucuuaccaccacacuaugauagugcuauugguuggaacaaagaagaaccaaccacauacggaaaauuccuaaaccauggcgaaccuaaauuagcaugggaacgccaaggugauggaaguaugagauuccuauucauggauucauuucacaaaaugauggaagauuucgccccacaucaacccgcucucguugcagauggccgaaaaauaccucuagacuggacauuauacuacuuacguaaaaaggcucugacucagccuauuaaaaaggaggaacuggcauggauucuauuaaauuucaaucagaaaagaggcuauuaccaacuacgaggagaagaagaagaagaaaacccaacaaaaagagaagaguaccaugaacuuaaaguaguuagcguagaagcagcggaagaagggaaaggagguaauacaugguacaacgugaaauuagaaaauggauggauauacagaagaagcaguaaaauaccgcuggacgacuggguagggaaaacgcggccauucauagucacaaccgaguaugaggcugauggaauuacauuaaagaaaaauaaagaaggagaaguuaaaagaaguuuccgagcuccaggcgaggaugauuggggccuuagaaagaaaagaacugaaucacaacuugaagcaucagggaaaacaguaggagcguuuaucuacgaccaucugcucgcagaaccugccgacaaaauacggggcaacuucauaagaacuaucgagcgaaaauauuacaaacaagaacuugcagauauacuccgugaacaaucaaaauaccaugaagaacuacaaaguaagaaaauucuugcagacugcgcugaagaacuauauagaaguaaucagccacaucgagauagcuuauuaaagaaagauaugguauaucuacuauuaacagauauaauauuuuaucagagaccacucaaaucaaagaaaucacuuauagcugacugcccuuaugaauauuaugaauacguagacaaagaaacaggagaaaucaaacgccaaggaauaaaauguguagcaaaaaguaacccauacuaucaggaauuuagacuauggcaauuuguauuaaauuuaagacuauacgacagaacagaagauaaagaaguaacagcggaguaccuaccuucaaaagaagauuaugcucgauuauucguauaccugaacgaccggaaagagauuaaucaggaaacacuacucaaagauuucuuuaaauuaaagaaaguaaaacagcguagcgagaaagaauuuccggucagauggaauuacauagaagauaaagaaaagaaauacccauguaacgaaacaagacaugagcuauuaauggcucuagauagagccgguauagagagaaguugguuagaugacacagccaggcaaugucgauuguggcauuuauuguauaguauugaaguuaaagacgaagcagaaagagcccuaagaaaacuuaaagacgaugaugaauuugucagcgcauuuuuaaaagugaaaccguucaagaaagauuauggcgcuuacucggaaaaagccguaaagaaacuguuagcaguaaugagaaugggaagucauuggugugaagacgauauuuguaaagaaacaaaagaacguauugaacauauacuucaaggagauguagaagagaaaauaaaagaacggaugaaccacaccgcauacucacuaggagaacuuuccgauuuucaagcacuaccagaauggcuagcauguuauguaguuuaugguaggcauagcgaagcaacagauauaaaacacuggaaaaccccugaaucguugauggcguacauaaauggauucaaacaacacuccuuaagaaaucccauaguagaacaauguauacuagaaacguuaagaaccguucaugacauauggaaagaagccggccauauagaugaaauucauguagaacuagggagaaguaugaaaaguacuucagaccaaagagcacgcaugaccgaaaauauacucagaaacgaaaacacaaacuuaaggauaaaaucccuacugauggaauuaaagaacgaugcggauauuaaagaugucagaccauacucaccaaugcaacaagaaauccuaagaauuuacgaagaaggugcacuccaagaauuaacaaaagaagacaacgauuaugaagaaauuuuuaaaauaucuaaaaugccccaaccaucagcaaaagaacuacugaaauauaaacucugguuagaacaaaaauaucgguccccguauacagguaaaccuaucagucuaaguaaacuguucacuuccgcguaccaaauagaacauauaauuccacaaagccgauauuuugacgauucuuucaauaauaaaguaauuugcgaaucugaaguaaaugcucuaaaaggaaacaugcuagguuaugaauuuauuaaaaaucacgguggcgaaauaguacauugcacacuacuuggcgaugugaaaguucaaaacgaaagugaauauaaagcguucgugacugaacauuaugcaaauaacaaguauaagaaagagaaauuacuaauggaggauauaccacaagauuuucuaaaucgacauuugaaugauucaagauacaucaguaaagugguaaaaacacuacugucgaacauuguacgcaccgaagaugaaauggagacaacaaguaaguuuguuguuaguuguaccggaggaauaacagauagauuaaagaaagauuggggccuuaacgacgucuggaacucuauaguauauagccguuucgaaagacuaaaugaacucaccaaauccgacgcauuuggucgcugggaaaauaaagaaggcaaaaggguauuccaaacauccguaccuuuagaacuacaaagaggauuuaauaagaaaagaauagaccauagacaccaugcgauggaugcccuaguaauagcuugcgcaagccgaaauauaaucaauuaccuuaacaacgaaucagcaaacagcccgaagaaaagagaagacuuacgacaacaacuaugcgacaaaaacagaauaauacgaaaaccgugggaaucguucacccaagaugcacgagcagcacuagaggauguuguaguaucauuuaaaaauuauguuagaguaauuaauaaagcaaccaauuauuacgaaagguacgacgcagaugggaagaaaacgauaacuaaacagaaaucacgugagaugugggcaguuagaaaacccaugcauaaagaaacuguauuuggacacguaaaucuaagaagaaaagcuauuguaaaauuaaaagaugcauuagaaaauauuccaucaauaugcaauaaagaauuaagagauuacauaaacggauuagucgagcgaaauuuuaacacaaaacagcuucacgcacacuucagauccacggauuaucgcuggaacaaacaaaauguugauaaaguggaaguauggagguucucagaugaaaaagaaccccuagucgccaccaggaaaccauuagacaccaguuucgaugcuaaaaggauagacacuauuacagauacuggcauccagaaaauacuguuaaacuacuuggaggcuaaaggaggcgauccacuaauagcauucacgccugagggcauugcggaaaugaaucaaaauauagcauuauauaacgaugguaaaaugcaccaaccaauacuaaaaguaagaauauccgaaccaaaaggagcuaaauaucaaauaggucaaacaggaaacaaagccgauaaauuuguagaagcccaaaaagguacuaaccuauacuucgcaaucuaugaggacgaggacaggaauagaacauauaauacaauaccacuaaaugaaguagcagagagacuaaaacaaggacucccacccguuccggagaaaaacgaaaaagaaguaccuuuaaaguucuacuuaaguccaaacgacuuaguauaugucccaacagaagaagaaauucuaaugaaagaauguaaauuaaauaaaaacagaauuuacaagaugguaucuucuacgggcaaucaaugcuucuuuauaccauuuagaguagcaguaagcaucgugaauaaaauggaauauagcccgcugaacaaaauggaaaaagcaauuucuuccgaaaugaucaaagcuguuugcuggaaauuagaggucgacagauuggggaauauaauaagagugguuaaauga

SEQ ID NO: 9198 - RNA, 4452 nt, Artificial Sequence
  Cas9 variant
augaaaacuauacuaggccuagaccuaggaacaaacucaauaggaugggcaaaagucucauuggaugauaauggaaauuaucuacacgacaucaaacuagguugcagaauaauuccaaugagucaagauguuuuggacaauuucgggaaagguguuacaguaucacaaacaucaguucguacgggcuucagaggcguacgccgcauaagggaacgaucacuacaaagacgagaaagauuacauaggguauuacaucgucuugguuuucuaccacagcauuaugacgccgcaauaggaugggauucagacugcgcuaaaacauauggaaaauuccucgacaacggggaacccaaacuagcaugggaaagacaagaagauggaucgaugcgauuccuauuuaugaacucauuuuaugaaaugauagcugauuucacaagucaucagcccgcauuaguggcugacggaaagaaaauuccacucgacuggacauuauauuacuuacgaaagaaagcucuaacacaggcaauacguaaagaagaacuugcuuggauacuacucaguuucaaucagaaaagaggcuacuaccaacuucguggugaagaagaagacgaaaacccaaccaaaagagaagaauuuugcgaauuaaaaguaguagcugucgaagcagcugaaaaagguaaaggagacgacauaugguauaacguccacuuagaaaacgguugcauauaccggcgaucaagcaaaauuuccuuagacgauugggugggaaaaaccaaacaauuuauaauaaccacagaguaugaaaaagauggaguaacaccuaagaaagacaaagacggaaaagagaaaagaucauauagagcacccaaagaagaugauuggggacucagaaagaaaagaacagaaacagacuuagaagcaucugguaaaacaguaggcgcuuucauauaugaacaucuacuugcagagcccuucgauaaaauacgaggaaauuucauacauacgauugaaagaaaauacuauagagcggaauuggaagcaauauuaacagaacaaagaaaauaucaugaagaacuaaggucagagcaaaugcucgcaguuugugccgaggaauuauauagaagcaacuuaccucaucaacaaagucuuuuaaagaaagacaugguauacuuauuauuaagcgacuuaauauuuuaucagaggccacugaaaucuaagaaaucccuaaucgcugauuguccauacgaauauuaccgguacguugauaaagaaacuggagaaaucaagaaacaagguauaaaaugcauugcaaaaucaaauccuuauuaucaagaguuuagacuguggcaauucguucuuaaccuuagauuauucgauagaaugacagacaaagaaguaacagcagauuauuuaccuacgaaagaagacuacguaagauuauuugauuaccuuaauaauagaaaagagauaaaucaagaaacacuucuuaaagacuuuuucagauuaaagaaagucaaacucgguagggagaaagaguucgaaauaagauggaauuacauagaagauaaagagaaaaaguauccgugcaacgaaacgcgauaugaacuacuuguagcauuagacagagccggaauugauagaaguuggauagacgaagacgguaggcaauacagacuauggcaucuacucuauucgauagaaguuaaagcagaagcugaaagcgccuugcgaaaacuaaacuccgacgaugccuuugucagcagcuuccuaaagguaaaacccuuuaagaaggauuauggcgcguauagugaaaaagccgugaagaaauuacuggccguaaugaggaugggaucaauguggucagaagcaaauaucugugaagaaacacaaaauagaauaagaaguaucauacgcggugacaucgaagagaaaaucaaagaaagaaugggacauaccgccagauccuuuaaucaaauugaugauuuucaggcuuuaccagaauggcuagcaugcuaugugguauacgggagacacucggaaguaacagacauacaacauugggaaacaccagagcaacuccaaucauacaucaacgguuucaaacaacacuccuuaagaaacccuaucguagagcaaugcauacuagaaacacuuagaacuguucacgauauauggaaagaggcaggacacauagaugagauacacguggaauuaggaagagauaugaaaagaacagcugaucaacgagcacggaugacuaaaaacauccuuaaaaacgaaaauacaaauuuacguaucaaaucacugcugauggaacuaaagaaagacaccgacauuaaagaaguaagaccauauucaccaaugcaacaagaaauacuacgaauuuacgaagaaggagcauuacuacaacuaaaaagagacgaugaagcguucgcugauauaagcaaaauaagucaaauggcacagcccacugcaacagaguuacgccgauauaaacuguggcuugaccaaaaauaucgaaguccauacacaggaaaauuuaucagcuuaucaaaacuauuuaccucugcauaccaaauagaacacgugauaccacaaucacguuauuucgaugauucauuuaguaauaaaguaauaugugaagcagaagugaacagguuaaaaagcaauaugcuagguuaugaguuuauaaaggcccauggaggagagauaguccauuguacaaugcuuggagauguaaaaauacuaucagaaagcgaauauaaagcauuuguaaaugagcacuauguaaaucauagagcaaagaaagaaaaacuacuaauggaagauauaccacaagaauuucugaauagacaaaugaaugacagcagauauaucucaaaaguaguaaaagcacuuuuaucaaacauugucaggacagaggaugaaauggauguaacaucaaaauuuguagugccaugcucaggcggaauaacagacagauugaagaaagacuggggauuaaaugacguuuggaauagcauugucuacccaagauucgaacgacuaaaccgaaugaccgggacugaagcauuugggcauugggaaaauaaagaaggaaaaaggguauuccaaaccucaguaccaauagaauuacaauuaggauucagcaagaaaagaauagaccaccgacaucaugcgauggacgcccuagugauagcaugugcaucaagaaacauaaucaacuauuuaaauaacgaaagcgcaaauagccaaaagaaacgagaggauuuaagaagauuacuaugugauaaaaacagaauuauacgcaagccaugggagucauuuacacaagaugcgagaguagccuuacaagauauagucguuagcuucaaaaacuacguccgaauuaucaauaaagcaacaaauuacuacgaacgauacgacgaacaagguaagaaaaccacagccgaacaaaagagcuccgaaaugugggcaauaagaaaacccaugcacaaagagacaguauucggacacguaaauuuaaaaagaaaaacaaccguaaaauugaaaaaugcuauugaaaauauuccaaauauuuguaauaaagaacuaaaagcauacauuaacgagcuuguagaaaaacauuucaauacaaaacaaauguuagcccacuuuaaaagcauaaauuauagguggaacagacaaaauguagaaaaaguagaaguguggcaauacagugaugagaaagagagaauggcugcaacaagaaagccacuugacacaaguuuugauaagaaacguauagaaacgauaacagauacgggcauucagaaaauacuacugaauuacuuggaagaaaaaggaggggauccuaauauagcguucacgccggaaggaauagcagaaaugaacaaaaacauuaguuuguuuaacgaugggaaacuucaccaaccuauacuaaagguacguguggcgaagacaaugggagcaaaauaucaagugggacaaacaggaaacaaagcagccaaauaugugggugcccaagaaggaaccaauuuauacuuugccaucuaugaaaaugaagagggugaacgaaguuauaaugcuguaccguuaaaugagguagcagaaagacuaaaacaaggaaugucacccgugccagagaaaaacgaaaaggaugugcccuugaaauuuuaccucagcccuaacgaccucgucuacgucccgacagaagaagauaaauuaucaaacgaaugcaagcuagauaacgaaagaauauauaaaauggugucggccacagggaagaaaugucauuuccuaccauauucaguagcgaacauuauauauaauaaaguggaauuugaaaguaugaauaaaauggguaaagcacuaucaggagaaaugauaaaagcuguaugcuggaaacuagaaguugauaggcuugguacuauccuuagaguuauaaaauga

SEQ ID NO: 9199 - RNA, 4452 nt, Artificial Sequence
  Cas9 variant
augaaaacagaacuggaucuaaacaaggauagauuauacaaacacguauuaggguuagaccuaggcguuacaucgauaggcuucgcacacguaguagaaucugaaaacagaaacgaaucugaaaucaaacaaauaggaguuagaguuauacaacucgauaauuucgauaaaguggauaaaaguggcaaaacuucagaaaguaaaaauccagcaguagacuuugcagcagguaaaggacucacaccaaaugguucuagaacuaaaaaaagaggagcuagaagaaaccuagacagauaucaagaucgacgagacaauuuacuagagguccuuacaaaaucaggauucauaaacucugagacaaaaagaacagaagauggaaaacacacuacccaccaaacaugggaaauccgcgcgaaagcagucuccgagaaaguagaaaaagaagaguuugcaagaaucuuacuugcaauaaacaaaaagagaggauauaaaucaucacgaaaagcaaaaaacgaagacgagggacaagcaguagacggaauggcaguagcaaaacgccuauaugaggaaaaccucacuccuggacaauacgcauacgaaguacuuaguggaggcaaaaagagcauaccggauuuuuaccgauccgauuuacaagccgaauucgacaaaauuuggaacuuccagaagcaauuuuauccgaacauucucacggacgaauucuaugaagaacuuaaaggcaagggccaaagagccacaucugcagcauuuuggaaaauacaccaauucaauacagcggacauaaaagauuuagaagaugaauuaaaaaacgaaagaacaauuaaacugagcaaaagagaccaaaaaaagcuacaagccuacaaguggagaucagaagcugugguuaagcaauuagggaaagaggaagucgcauacguccuaacugaaaucaacaauaaucuaaacaacagcuccggguaucuaggagccauuucagauaggucaaaagaacucuacuucaauaaacaaacggucggacaauuccuauacaaacaacuuaaagagaauccucauacaagauuaaaaaaccaaguauucuaccgucaagauuacuuagaugaauucgaaacaauaugggaaaugcaagcacaauuucauccugaauuaacacaagagcuuaaggaagaaaucagagacauaaucauauucuaccaaagaaaauuaaaaucucagaaagggcuaaucuccuuuugcgaacucgaaaguaaagaagugguaauaaacgacacaaaaaaaauaauaggacuacgcguggcaccaaaaaguucaccucuauuccaagaauuuaaaauauggcaaaaccucaacaacguacuaguaagaaaaaaaggaucaagaaagcgcauggucaaagcacaaaaucagcauagucuguuugaagagcccaaagaaauauuuuccuuagacuuagcaaguaaagaaaaacuauuugaagaacuaaacuugaaaggaaaccugucagccaaaaacugcuuagacauacuaggauuaaacucaaacgaaugggaacugaauuacacccaauuagaaggcaacagaacaaauaaaagcuuauacgaagcuuucuuaaaaauacuagacauagaaggauaugacgucaaagaccuacugaaaguuaaauccuccaaagaugaaguagaacuagacgaucuaaaaguaccagcuucggagauaaaaaauaugguucgcgaaauuuuuaguacuaauaaaauagauaccgaaaucuuagacuuugacgcagaaauugacggaaaagcguucgaaaaacaaaguucauaccaacuauggcaccuacuuuacuccuaugaaggagaugacucgcaaucaggaaacgaaaaacuauaugaacugcuagcaaagaaguucggauuuaaacgagaacacgcucaaauacucgcgaauguaagucuaguagacgacuauggaaacuugagcagcaaagcaaugagaaaaauauacccgcacaucagagaaaauaauuacaguacggcaugcgaauuaguaggauauagacauuccaaacauucuuuaacaaaagacgaacuaaaggaccgcguacuugaagacagacuugaauuacuaaaaaaaaacucacuaaggcaaccgguaguagaaaaaaucuugaaucagaugauaaaugcaguaaacgcacuuauagaaaaaaacucagaacgcgaugaaaauggaaacauaacaaaauauuucaaauuugaugaaauaagaauagaacuagcccgagagcucaagaagaacgcugcagaaagagcugagaugacaacuaauaucaacgcugccaaauuaguacaugaaaaaauauuuaaaauccuccaaaaugaauucgguaucaaaaauccaaccaggaacgacaucauuagguacagauuguaugaagaguuaaaggguaauggauacaaagaucuauacuccaacacuuauauaccucgagagauauuauucucaaaccaaauagacauagaucauauccuaccacaaucgcgacuuuuugacgacucguucucaaacaaagucgugguuuuuagaaaagauaaccugaaaaaaggaaaucagaccgcaauagauuacauaggaagugaaguaggagaagagggccucaaaaacuucauagaaaggguggaaucuuuauaugaacuaggaaaaaaaaauaaggaagaaggaauuucaaaagcuaaauaccaaaagcuauuaaaaucagccagcgaaauaggagacggauucauagagagagaccuacgagaaagccaauauauagcaaaaaaagcuaaagaauuauuauuuaaagugacucgcucagucguuucaaccucaggcucaauuaccgauagacuacgagaggauuggggacuaauaaacguaaugaaagaacugaaucuccccaaauacaagucucuaggcuuaacagaaauacaagaacgaaggaacggucaccaaguagaaguuaucaaagacuggacaaaaagaaacgaccacagacaccaugccauggaugcauuagcuguagcauuuacuaagcauaaccacauacaauauuuaaauuauuuaaacgcgcguaaaaaugaaucccacaagcuucaugggaauaucaucgcuauagagacgcuagaaacagaaguaaaaauugaugacuuggggaauaagaaaagagucuuuaaggaacccauaccaaacuuucgacagguagcuaaagaacaccuggaaaauguacuaauaucacauaaggccaagaauaaagugguuacaaaaaacaaaaacaaaauauccggaaaagaaaaacuucaaauaacgcugaccccgcgaggccaacuccacaaagaaaccguauacggaaaauaccgcuucuaucaaaguaaagaugagaagguaucagccaaauucgauuuagaaacaaucgaaaagguugcaaacccaucguauaaagcagcguuacuucaaagacuaaacgaaaacgaaaaugacccaaaaaaggcauucagcggaaagaacgcacucucaaaaaauccuauauauauaucuauggagaaugacauaaaaguuccagacacaguuaaacucguuugguuagaagaagauuacucaauaagaaaagacguaacuccagaaaacuucaaagacgaaaaaucaaucgaaaaaauacucgacgaagguguaaaaagaauucuaaaaaauagauugaaagaauuuggaggagacgcaaaagaagcauuuucugaucuggauaaaaauccuauuuggcucaacgaagaaaaaggcacaagcauuaaacgaguuagaauuagcggaguaaaaaaugcugaaccacuucauuacaaaaaggaucauuucggaaacgacauauuagaugguaauggaaacaaaauaccagccgacuuuguauccacaggaaauaaucaucacgucgcaaucuacaaagaaccagaauucgauaaaaaaggacaaccuguacuagacgaacugggaaaucaaaaauauaaccuccaagaaaaaguagucagcuucuuugaagcaguggaacgaguuaaccaaggauuaccuaucaucgacaaaacauacaaccaacauuuaggcuggcaauuuuucuuuacuaugaaacaaaaugaaauguucgucuuucccaaugaaaaaaccagauuuaaccccauagaaauagauuugcuagacccaaacaacaaaaagcugauaucacucaauuuauucagaguacaaaagauagcuaauaaaaauuacauguuccgucaccaccuagaaacuaacguugaugacaagaaagaaaugaaaaacauagccuuuauacacauacaaaguugcaacuuacucaaagaaauuaucaaaguaagacuuaaucaccuaggugauauaguaucaguaggugaauauuga

SEQ ID NO: 9200 - RNA, 4452 nt, Artificial Sequence
  Cas9 variant
augaaaacgauacuaggacuugacuuagguacaaauucaauaggcugggcgaaggucagcguagaugaucacggcaauuaucuacacgacauuaaauuaggaucgcggauaauuccaaugagucaagauauauuagggaauuucgauaaaggagucacugaaucacaaaccgcaauaagaacaggauuccggagcguuagaaggauaagagaaagaagucugcuacgacgagaacgccuacaccgaguacuacauguaaugggauuuuuaccuccacauuaugauagcgcgauaggauggaauagagaagaagcaaguacuuauggaaaauuccuaaaucauggagaacccaaauuagccugggagagguuggaagaugguucaaugagauuucuauucauggauucauuucaugaaaugauggcuaauuuugcacgucaucaacccgcauuaguagcagauggaagaaaaauacccuuagauuggacauuguauuaccucaggaaaaaggcauuaucacaagcagugggcaaagaagaacuggcuuggauucuacugaauuuuaaucagaaacgagguuauugccaacuuagaggagaagaagaggaagaaaccccgacaaagagagaagaauauuaugagcuaaagguggugucaguagaagcagcugaagagggaaaaggaggaaauacaugguacagagugcaauuagaaaacggcuggauauauagacguccguccaaaauugcacucgacgauuggguaggcaaaacuaaacaauuuauuguaacaacagaauaugaaaaagacgggacgacccugaagaaagacaaagauggcgaagugaaaagaaguuuuagagccccuggagaaaacgauugggggcugagaaagaaaagaaccgaaagucaauuagaagcaaguggaaaaacaguaggagcauuuauauacgaccaccuauuagcugaacccgcagacaaaauuagaggaaacuuuauaagaacaauagaaagaaaauauuacaaacaagaacuagaagccauacuucgagagcaaacaaaacaccacgaagaauuaagaucuaaagaaauguuagcaaagugugcugaagaacucuaucaaagcaaucaaccccacagaaaaucacuacuaaacaaggauaugacauacuuauuacuaaccgaccuuauuuucuaucaaagaccccuuaaaucuaagaaaagucuuauugcagaaugcccuuacgaauauuauaaauacaaagacaaggaaaaaggaaagaagaaacggcaaggcauuaaaugugucgcuaaaaguaaucccuacuaucaagaauuucgacuguggcaauuuauaguaaaccuaagauuauucgauagaacagacgauaaggaaguuacagcagaauaucuacgaagucgggaagauuaugcaagacuauuugcauaccuaaaugaccgcaaagaaauaaaucaagaaacauuauuaaaagauuucuucggucuaaagaaaguaaaaauuggagcugaaaaagaguucgcaauuagauggaacuauaucgaagauaaagaaaagaaauauccaugcaacgaaacacgacacgaacuuuuacuugcucuagauagggcuggaauggacagaucauggcuagaugauucugaacuucaauaccgauuauggcaucucuuauacagcguagaagcaagagaugaagcagaaggagcauuaaggaaacuaagagaugaugaugaguucguaggagcauuucucaaagucaaaccauuuaagaaagauuacggagcuuauucugaaaaagcaguaaagaaauuauuagcuguaaugagaaugggaucaugguggcaugaggaagauauuuguaaacaaacgagggauagaaucgaaagaauugugcaaggagacaucgaagagaaaauaagagaaagaaugggccacgccgcauauucuuuuucuagauuagcagauuuccaaggacuacccgaauggcuagccuguuacguaguauauggcagacacagugaagcuacacacauauuacgaugggauucaccagacaaacuauugucauauauaaaaggcuuucgacaacauucacuaagaaaccccauuguagaacaauguauccuugaaacuuuaagaacuguacaugauauauggaaagaagcaggacacaucgacgaaauucacguagaacugggaagauccaugaaaucaacagcugaacaaagagcucacaugacgaaaaauauauuacgaaacgaaaauacaaauuuacgaaucaaaugccuucuuauggagcuuaaaaaugaugcagaugucaaagacguaagaccauauucuccgaugcaacaggaaauacugaggauuuacgaagaaggagcccuucaacaacugaccaaagacgaugcggaauacgcagaaauuaguaaaauaucgaaaauggcccaaccauccgcuaaagaauuauugagauauaaacuuugguuggaacaaaaauauaggucaccauauacagggaaaccaauaagccuaucaaaacuuuucacaucagccuaucaaauugaacacguuauuccacaaagccgcuauuuugaugacucuuuuaacaauaaagugauuugugagagugaaguaaauacucuuaaaaguaauaugcuaggcuaugaguucaucaaaaaucacugcggcgaaauaguccauugcacaaugcugggggacguaaaaguauucagcgaaucagaauauaaagcauucgucacagaacauuacuccaacaauaaauauaagaaagaaaaauuacugcuagaagacauuccacaagaauuucuaaacagacaaaugaaugauucacgcuauauauccaaagugguaaaaggucucuuaaguaaugucgucagaaccgaagacgaguuagaagccacaaguaaauuuguugugaguugcaccgguggaauuacagaccgauuaaagaaagacuggggccuaaaugauguauggaauagcauaguguauucuagauuugaacgcuuaaauggacuaaccaaaagcgaacauuucggacacugggaaaauaaagaagguaaacggguauuucaaacuucaguaccaauggaacuucaacgaggguucaauaagaaaaggauagaucauagacaucacgccauggacgcauuaguaauagccugcgcaucucguaacauaauaaauuaucuaaacaaugaguuugcaaaaucaccgaaacagagagaagaccuacgacaacuauuaugcgacaaaaauagaauuauuagaaaaccaugggaaacuuuuacacaggaugcccgagcagcucucgaggaugucgucguaucauucaaaaacuauguaagagugaucaacaaaacaacaaacuauuaugaaagauaugacgccgacggaaagaaaacaauggucccacaaaaaggaaaugaaaugugggcagugagaaaaccaaugcaugaaggaacaauguauggacgaguaaacuuacgacgaaaagcagucgucaaacuaaaagaagcauuagaaaacauaaguaguauauguaauaaagaauuacgugauuauauaaacguauuaguagaaaaacaauuuaauacaaaacaacuauuagcacauuucaaaagcauggauuacagauggaacaaacagcacaucgauaaagucgagguauggagauucuccgacgaaaagguucaaaugguugcagccaggaaaccguuggauacuagcuuugacaaagaguguauagcgagcauaacagauacugggauucagaaaauauuauuaaacuaucucgaaucgaaaggaggagacccugcaauagccuuuacaucugaaggaauagcugaaaugaaccaaaacauagcaguuuacaacgauggaaagaaacaucaaccaguuauaaaaguacgaaaaucaacaaaauuagggaaaaaguucgcugugggacaaaucggcugcaaaucaaaacaauuugucguugcugaagccggaacaaacuuauauuuugcaauauacgaagaugaagaagggaaaagaagcuaugacacuauuccucuuaacgagguaacggaacgauugaaacaaggucuaagcccgguuccagaaaagaaugagaaagaaguuccauuaaaguucuaucuaagcccaaaugaucuaguauauguaccgacagaagacgaaaugcaaaugaaagaguguaaacucaauaaggaacgaauauacaagaugguaagcaguacagguaaugaaugucacuucuuaccauauagcguugcgucaguaauauacaacaaaguagaguucgaaucaaugaacaaaaugggccgggcuuuaacuggggaaaugauuaaggcagugugcuggaaauuggauguagauagguuaggaaauauacuacggguaaucaaauga

SEQ ID NO: 9201 - RNA, 4452 nt, Artificial Sequence
  Cas9 variant
augaaaaccauauugggauuagacuuaggaacgaacucaauagguugggccaaaauaaguauagacgauaacggcaauuacuuaagagauauacagcugggaagcagaauaauacccaugagccaggaugucuuaggcaacuuugauaacggaguaacagagucacagaccgccgugcguacaggauuuaggggcuuaagaagaauaagggaacgaagccuccuucgcagagaaaggcuacacagaguauuacauguaaugggcuuucucccaccacacuaugauagugcaauuggauggaauaaagaagaaccaacgacauacggaaaauuccucaaccauggggaaccaaaacuagcuugggaaagacaaggcgauggcagcaugagguucuuauucauggacucauuucauaaaaugauggaagauuuugcgccgcaccaaccagcauuaguagcagacgggagaaaaauucccuuggauuggacacuauauuaucuaagaaagaaagcacuaacucagcccauaaagaaagaagaacuggcguggauucugcuaaauuuuaaccagaaaagaggguauuaccaacuucgaggugaagaagaagaagaaaauccuacaaaacgagaagaauaucaugaacuaaaaguagucggcguagaagccgccgaagaggguaaaggaggaaacacaugguauaacguaaaacuagaaaacgguuggaucuaucgacgcucaagcaaaauuccucuagaugacugggucggaaaaaccagaccauuuauaguaacaacagaauacgaagcagacgguaucacacugaagaaaaauaaagaaggcgaaguaaaaagaaguuuuagagcucccggagaagaugauuggggcuuauggaagaaaagaacagaaagucaauuagaagccucaggaaaaacugucggggcuuuuaucuacgaccaucuacuagcugaaccagcagauaaaaucagagguaauuucauucgcacuaucgaacgaaaauacuacaaacaagaacuagcagauaucuuaagagaacaaaguaaauaccaugaagaacuacaaaguaagaaaauacuugcugauugugcagaggaacuauacaggaguaaucagccucauagagauucccuauugaagaaagauauggucuaucuauuauuaaccgaucuaauauuuuaccagaggccgcuaaaaagcaagaaaaguuuaauagccgauuguccauacgaauacuacgaauauguagacaaagaaacuggagaaauuaaaagacaagguauaaaauguauagcuaaaaguaauccauacuaccaagaauuucgacuauggcaauucguccuaaaucugcgauuauaugacagaacagaagauaaagaagucacagccgaguaucuuccaagcaaagaagauuacgcuagacucuucguauaucugaacgaccgcaaagaaauaaaucaggaaacauuacuaaaagacuuuuucaaacuaaagaaaguaaaacagagaucagaaaaagauuuuccaguuagguggaacuacauagaagauaaagaaaagaaauauccauguaacgaaacuagacaugaauugcuuauggcacuagacagagcuggaauagaaagaaguuggcuagaugauacggcacgacaauauagacuguggcauuuauuauacagcaucgaaguaaaagacgaagcagaacgagcacugcggaaauuaaaagacgaugaugaauuugucagcgcauuucugaaagucaaaccuuucaagaaagauuauggugcauauuccgaaaaagcgguuaagaaacuccucgcgguaaugaggaugggaucgcacuggugcgaagaugacauuuguaaagaaacuaaagagcggauagaacauauucugcaaggugauguuggugaaaagauuaaagaaaggaugaaucacaccgccuauagucugggugaauuaucagauuuccaagcgcuaccagaauggcuagcgugcuacguagucuauggaaggcauagugaggcaacagauauaaaacauuggaaaacaccugaaucauuaauggcauacauaaauggauuuaaacaacauucucuacgaaacccaauaguggaacaaugcauuuuagagacgcucaggacaguccaugacauuuggaaagaagcaggacauauagacgaaauacacguggagcuaggcagaaguaugaaaagcacaucagaccaaagagcacgaaugacagaaaacauuuuaagaaacgaaaauacaaauuugagaauuaaaucacuacucauggaacuuaaaaaugaugcugacauaaaagauguuagaccauacucuccaaugcagcaagaaauauuaagaauauacgaagaaggggcauuacaagaacuaacaaaagaagauaacgacuacgaggagaucuuuaaaaucucaaagaugccacaacccucagcuaaagaauuacuaaaauauaaacuuuggcuagaacaaaaauacagaaguccauauacaggaaaaccaauuucauuaaguaaacuuuuuacgucggcauaucaaauagagcauauuauaccacaaucgagguauuucgacgauucauuuaauaauaaagucauaugcgaaucagaaguaaaugccuuaaaagguaauaugcuaggauaugaauuuauuaaaaaccacggaggagaaaucguacacuguacacuucuaggggacgugaaaguacaaaaugaauccgaguacaaagcauuuguaaccgaacacuaugcaaacaacaaauacaaaaaggagaaacuauugauggaagauauaccacaagacuuccuaaaucgacaccugaacgacucucgauacauaucaaaaguugucaaaacauuauuaagcaacaucguaagaacggaagaugagauggaaacuacaucaaaauuuguaguuucaugcaccggagguauuaccgauagauugaaaaaggauuggggguuaaacgaugucuggaacucgauuguauacucacgauucgaaagauuaaacgaauuaacgaaauccgaugcuuuuggucgaugggaaaauaaggaaggaaaaagaguuuuucaaacuagcguaccacuagaauugcaaagaggguuuaauaagaaaagaauagaucauagacaucacgcaauggaugcacuggugauagcuugugcaucuagaaacauaauaaauuauuuaaauaacgagagcgccaacucaccaaagaaacgagaagacuugagacaacaacucugugauaaaaacagaauaauaagaaaaccaugggaauccuucacacaggaugcaagagcagcauuagaagauguuguaguaaguuucaaaaacuauguacgagucauaaauaaagcaacuaauuacuacgaaagauaugaugcagacggcaagaaaaccauaaccaaacagaaaaguagggaaaugugggcggucagaaaaccgaugcacaaagaaacuguauucgggcauguaaaucuaagacgaaaagcaauaguaaaacuaaaagacgcuuuagaaaauaucccgagcauauguaauaaagaacuaagagauuauauuaacggucuaguagaacgaaauuucaauacuaaacaacuacacgcccacuuuagaucuaccgacuaucguuggaauaaacagaacguagauaaaguggaaguuuggagauuuucagaugagaaagagccucuaguagcgacaagaaaaccuuuagauaccaguuucgaugcaaaaaggauagauacuauaacagauaccggcauccagaaaauauuacuaaauuaucuugaagcaaagggaggagauccgcuaaucgccuuuacuccagaaggaaucgcggagaugaaccaaaacaucgcgcuuuauaacgauggaaaaaugcaucaaccuauucuaaaaguucgaauaucagaaccgaaaggggccaaauaucaaauaggucagacggguaacaaagcagauaaauuuguggaagcucaaaagggcacuaauuuauacuucgcuauuuacgaagacgaagaccgaaauagaacauauaacacaauaccgcuaaaugaaguagcagaacgacuaaagcaaggccuaccaccaguuccagagaaaaaugaaaaggaagugccacuaaaauuuuaccuaucgccuaaugauuuaguuuaugucccaacugaagaagaaauacuuaugaaagaauguaaacuaaacaaaaaccgaauauauaaaaugguaucaucaaccggaaaucaaugcuuuuucauacccuucagagucgccgugaguauuguaaauaaaauggaauacucaccacugaauaaaauggaaaaagcaaucucaagcgaaaugauuaaagcagucugcuggaaauuagaaguagauagacucggaaauauaauuagaguaguaaaauga

SEQ ID NO: 9202 - RNA, 4458 nt, Artificial Sequence
  Cas9 variant
augaaaaacauacuuggccuggaucuugguacaaacucuauagguugggcaaaaauauccauagacgauaacggaaaguauauaaaagacagcauaaaacuaggaucacgcauaauaccaaugucacaggacguacuaucaaacuuuaguaaaggaguaacccuaucucaaacuucagaaagaacaucuuucagaggagccagacgucuccgagaaagaacacuauuaagacgugaaagacuucacagaauccuccaucuuuuaggcuuucuaccaaaacacuacgaaaaggcgauagguugggaccgaaacgauaauaaaacauacggcaaauuuauuaaucaugcagagccuaaacuagccugguguaaagacaauaaugguaaaaugcgcuucuuauucauggauaguuuucacgacaugcuaagcgaauucagcgaaaaacauccagaacuauuagcaaauggaaaaaaaauaccacuagauuggaccauauauuaccugagaaaaaaagcauuauacaaagcaaucacaaaggaagaacucgccuggauuuuacuuaauuucaaucaaaaaagaggauacuaccaacuacggggcgaagaagauagagauucagaagcuaauaaaaaagaauaucuggaguuaaagguuauaggcguggaagccacuggugaaaaaaaagguaaugacauaugguacaacauacauuuagaaaauggcuggauauacagaagaucgucaaaaaaucccuuaaacgacugguuagguaaaguuaagucauuuauugugacaacugaucuagacgcugacggaaacccgaaaaaagauaaagaugggaacauaaaacggaguuucagagcaccauccgaaggggauuggacacucauaaaaaagagaacagaaucacugcuggaaaauagcggacaaacaguaggucaauucauauauaaucauauacuagaagagccgucugcaaaaauucguggaaacuucauuaggacgaucgaacgaaaauauuacaaagaugaauuaaaagcaauccuagaaaaacaaaaagaguuccaucaugaauuaucaagcgaaucauuacucacagaaugcgcuaaagaauuauauaagcguaauauugcacaccaagaaguuuuacuaaaaaaggguaugauccauuuacuacuaaacgauauacucuucuaucaacggccucucaagauaaaaaaaucgcuaauagauaacuguccuuaugaaaacuauaaauacguagacaaaaaauccggcgauauaaaaguuaaaucaauaaaaugcauagcgaaaucuaaucccuuuuuucaagaauucagacuauggcaauuuguaucgaacuuaagauuauaccguaaaucagaugacaaagacguuacgagugaacaucucguuacuacagaugacuacgcuaaucuauucacauauuugaacaauagaaaagauauaaaacagagugucuugcucaaagaauacuuuaaaauaaaaaaaguaaaaacgaucaacggcgcugaguaucccguacgauggaacuauaucgaugacgauaacaaaacauauccgugcaacgaaacaagauaugauauacuccacgcacuaucaaaaacugaacugaaaucagaauggcuaacaccagagagaacauacagauuguggcaccucuuauacuccauagaaaguaaagaagaaacaaaaaaagcuuuaaacaaacucaaucuaucugaugauuuuacagaagcauuccuaacaaucaagccauucaaaaaagaauauggaagcuacuccgaaaaagcaauaaaaaaacuacucagucuaaugcgaauggguuacuuauggucagaagacgaagcuauaaaacaagucggugcagaaauagaaaaaacgauagaaggcgagcuaccagacuauguacuacagagacucgaaaaaucacaacauaauuacaacaaaauaucugacuuuagcggauuaccucuauggcuagcgagcuacauuauuuauggaagacacucagaggcaaaggaaauaauccauugggacaauccggaaucaaugauggcauacauaaaagacuuucgccaacacagcaugcguaacccuauaguugaacaaugcgucuuagagacauuaagaacgguacaugacauuuggaaagaaauuggacacaucgaugaaauucauauagaacuuggccgagaaaugaagaguacaucagaacaacguaaagcaauaacucagaacguauuacacaaccaaaauacaaacauuagaaucaaacuucuacuccaagaacuaaaaaaugauaauaauauuacaggagucagacccuacucaccaaugcaacaagaaauucuccguauuuacgaagaaggugcuuuacaagguuuaacuaaagaagauaaagacuauaacgacauucucaaaaucucacaaacugcucaaccuacgagcaaugaauuaacuagauauaaacuauggcuagaacaaaaauaucggucaccauauacgggaaaggcuauaagcuuaucaaaauuauuuacaucagcuuaccaaauagaacaugucaucccgcaaucgagauacuucgaugacucacuauccaacaaagugauuugugaaucagaaguuaacacccuaaaaaaagcaaugcuuggaauggaauucauaaagacuuguggcggccaaaaaguacacugcacacuauuaggagauguagaaauauacaaugaagaagacuacaaagcguuuguaaacgaacacuacaguaauaauagaaccaaaagaaacaaacuacuuauggaagacauaccccaagaauuuauaaacaggcaacucaacgacucaagauauaucagcaaaauggucaaacaacuacuaucugcaaucguacgaggacaggaagaaguugaagccaccagcaaauuuguaauaccgugcaccggaggaauuacagacagacuaaaaaaagacuggggacuaaaugauauauggaauaaccuaguaucaccucgauuccaaagaaugaacgcacuaacuggaagugaauauuuuggccacugggaaaacaaagaaggaaaaagaguuuuccaaacaaccaugccaauucaacuacaacaaggguuuucaaaaaaaagaauagaccauagacaccaugccauggacgcacuuguaauagcaugugcaucacgaaacauaauaagcuaucuaaauaacgaaacagcgcaagauacagaacgacgaagagauuuacgacaaaaauuaugcgacaagggaggaaguguacgcaaaccaugggauucauuuacucaagacacucaauaugcacuaaaagauaucaucgucaccuuuaaaaauuacguuagaauaaucaacaaagcaacaaacuauuacgaacacuauaaaacagauggaaagaaaggcaugaucucccagaagggugacgaauuaugggcaauacguaaaccuaugcauaaggaaacgguauuuggaaaagucaaccuaagaagaccaaagcgcgugagucugucuaaagcuauagacucaguagacguaaucugcaauagaaaacugaaaaaauauauaaaagcacgcuuaaacgaaggauugcaaaaaaaacaaauacuaaauauauuuaaagaaguuaacaacguaugggaaggcauagauguaaacaaaauagacauaugggaaaugaguaacgauaaggaaccaaugguugcaacucguaaacaacuagauacaagcuuugaugaaaaaaaaauccggagcaucucugauaccgguauacaaaaaauauuacuaaacuauuugauuacaaaaaacaauaauccggaacuagcauuuacaccagaaggcauacaagaaaugaauucaaauauauccgaauauaaugaccauaaaaaacaccaaccuauauauaaagugagaguaaccgaaccacuaggcgcuaaauauccaauugggaccauggguaauaaccccaagaaauuuguagaggcccaagcaggcacuaaccuauacuuugcaauauacgaggauaaagagggcaaucgaaacuacgacacaauaccgcucaacauugcugcagagcgucuaaaucaacaacuaucuccaguccccgagaccaacgaaaauaacacuccacugaaauuuuaccuaagcccaaaugauuugguuuauguacccucugaagaagaaagacauucuggaaacaacauacaacuugauaagaauaggaucuacaagaugguauccagcacaagcaaacaaugcuuuuucauucaccauaggguugcuauaagccuuguggauaaaaaagaauuuagugcucaaaacaaaauggaacgcaguauagacaaugagcaagugaugauaaaguccgugugcuggaaauuaauaaccgacagacucgggaauauaauaaaagucauaaaauga

SEQ ID NO: 9203 - RNA, 4458 nt, Artificial Sequence
  Cas9 variant
augaaaaacauacuugggcuagauuuaggaacaaacuccauaggcugggcuaaaauauccauugacgacaacgguaaauauauaaaagacuccauaaaacuaggcuccagaaucauaccaaugucccaggacguucuuucaaauuuuaguaaaggcgucacacucucgcaaacaagcgagaggacuuccuuucgcggugcuagacgacuccgagaacgaacauugcuacguagggaaagguuacaccguauccuacaccugcuagguuucuuaccgaaacacuacgaaaaagcaauagguugggauagaaacgauaacaaaaccuaugggaaauuuauaaaccacgcugaacccaaauuagcguggugcaaagacaacaauggaaaaaugagauuucuauucauggacucauuccacgauauguuaucagaguuuucggagaaacacccugaacuucuagcaaacgggaaaaaaauaccccuagauuggaccauauauuaccuuagaaaaaaagcacuauacaaagccauaacaaaagaagaacuagcauggauccuauuaaauuuuaaccagaaacggggauauuaccaauuacgaggcgaggaagaucgagauuccgaagccaacaaaaaagaauauuuggaauuaaaaguaauugggguugaagcuaccggcgaaaaaaaagguaacgacauaugguacaacauacacuuggaaaacggauggauauacagaaggucaagcaaaaauccacugaaugauuggcuaggaaaaguuaaaucguuuauuguaacaacagacuuagacgcagacggcaaucccaagaaagacaaagauggaaacaucaaaaggaguuuuagagccccaagugaaggagauuggacacuuaucaagaaaagaaccgaaucucuacuugaaaacucaggccaaacaguuggacaauuuauauauaaccacauauuagaagagccaucagccaaaauaaggggaaacuucauucgaacaauagaacgaaaauacuauaaagacgaacucaaggcgauauuagaaaagcaaaaggaauuucaccacgagcuuagcucagagucacuuuuaacagaaugugcaaaagagcuauacaaaagaaacauugcacaccaggaaguacugcuaaaaaaaggaauuauacaccuacugcuaaacgauauauuauucuaucaacguccacuaaaaauaaaaaaaucacuaauagauaauugcccauaugagaacuacaaguacguagacaaaaaaucaggugauauaaaagucaagagcauuaaaugcauugcaaaaucaaaccccuucuuccaagaauuucgucuauggcaauuuguuucgaaucuccggcuauaccguaaaucagaugauaaagacguaacaucagaacaucuaguaaccacagaugauuacgcuaaucuauuuacauaucucaauaauagaaaggacauaaaacaaucaguuuuacuaaaggaauauuucaaaauaaaaaaaguaaaaacaauaaacggagcagaauaucccguucgauggaauuauauagacgaugacaacaaaacguacccaugcaaugaaacaagauacgacaucuuacaugcacucagcaaaacugaacuaaaaucugaauggcuaacaccagaacgaacauacagacuuuggcaccuuuuauacagcauagaaagcaaagaagaaacaaaaaaggcauuaaauaaauuaaaccuauccgacgauuuuaccgaagccuuucuaacaauaaagccuuuuaaaaaagaauacggaucauauucggaaaaggccauaaaaaaacuguuaucauuaaugcgcaugggauaccuuugguccgaggaugaagcaauaaaacaaguaggagcagagauagaaaaaacaauugaaggagaauuaccagacuacguauuacagagauuagaaaaaucucaacacaacuacaauaaaauaagugacuucaguggccuaccacuuugguuagccagcuacauaauauauggucgacauucagaagcaaaagaaaucauacauugggacaauccagaaaguaugauggcauauauaaaagauuuccggcaacacuccaugagaaacccaaucguugagcaauguguauuagaaacauuaagaacuguccaugacaucuggaaagaaaucggacacaucgaugaaauacauauagaacuaggcagagaaaugaaaucaacgucugaacaacgcaaagcuauaacacaaaauguucuacauaaucaaaauaccaauauacgaauuaaacuauuacuucaagaacuaaaaaaugacaacaacauuacagggguaagaccguacagucccaugcaacaagagauacuucgaauuuaugaagaaggcgcucuacaaggcuuaacaaaggaagauaaggacuacaaugauauucuaaaaauaucacaaacagcacagccgacaucuaacgaauuaacaagauauaaacucuggcuagaacaaaaguaucgaagccccuauacaggaaaagccauauccuuaucuaaauuauucacaagcgcauaccaaauagaacauguaauaccucagucucgauacuuugaugauucacucucaaacaaaguaaucugcgaaagcgagguuaauacucuaaaaaaagcaaugcugggaauggaauuuauaaaaacauguggagggcaaaaaguacacugcacacuuuuaggggacguagaaauauauaaugaggaagauuauaaagcauucguaaacgaacauuacagcaauaauaggacaaagagaaauaaacucuuaauggaagauauaccucaagaguuuauaaauagacaauuaaacgacaguagauacauuucaaaaaugguaaaacaauuacuaucugccaucguacgcggucaagaagaaguagaagcaaccucuaaauucguuauuccguguacgggcggcaucacagaccgauuaaaaaaagauuggggacuuaacgacauauggaauaaucuaguaucccccagauuucaacgaaugaacgcucucacuggaagugaauacuucggacacugggaaaacaaagagggaaaaagaguguuucaaacaacaaugccaauacaacuccaacagggguucaguaaaaaacguaucgaccaccgacaucacgcgauggacgccuuagugauagccugugccaguagaaacaucauuuccuacuuaaacaaugaaacagcucaagacacagaaaggagaagggaucuucgccaaaaauuaugcgacaaaggcggaagugucagaaaaccaugggauagcuucacacaagauacacaauaugcacuaaaagauauuauagucacuuucaagaauuacguacgaauaauaaacaaagccaccaauuacuaugaacauuacaaaacugacgggaaaaaagggaugauaucacaaaagggagaugagcuaugggcgauucguaaaccuaugcacaaagaaaccguauucggaaaaguaaaucucagaagaccaaaaagaguuagccuaucgaaagcuauagacucuguagauauaauaugcaaucggaaacuaaaaaaauauauaaaagcaagauuaaacgaagguuuacaaaaaaagcaaauauuaaacauuuuuaaagagcucaacaauguaugggaagggauagacguaaacaaaauugacaucugggaaaugucuaacgacaaggaaccaauggucgccaccaggaaacaacuagacacaucguucgaugaaaaaaaaauacgaucaaucagcgacacugguauccaaaagauccugcucaacuacuuaauaacaaaaaacaacaacccugaauuggcuuucacaccagaaggaauccaggagaugaacucaaauaucagugaauauaacgaucauaaaaaacaucaaccuauuuauaaaguaagaguuacagaaccacuuggagcuaaauauccaauaggaacuauggggaauaauccuaaaaaguucguugaagcacaagcaggaacaaaucuauacuucgccauauaugaagacaaagagggcaagagaaauuacgacacuauaccucucaacauagccgcugaacggcuaaaucaacaauuauccccaguucccgaaacuaacgaaaacaauacccccuuaaaguucuacuuaaguccgaacgaucuaguauaugucccaucagaagaagagagacacucaggaaauaacauccaacuagacaagaauagaauuuacaaaaugguuucauccacuuccaaaagauguuuuuuuauacaccacagaguggcaauaucgcuaguugauaagaaagaauuuagugcccaaaauaaaauggagagaucaaucgacaacgagcaagucaugauaaaaucaguaugcuggaaacuuauaacggaccgauuaggcaauauaaucaaagucauaaaauga

SEQ ID NO: 9204 - RNA, 4458 nt, Artificial Sequence
  Cas9 variant
augaaaaauauauuaggacuugaucuuggaaccaauucaaucggaugggccaaaauaagcauagaugacaacgggaaauauauaaaagauucaauaaaauuaggaucccgcaucauucccaugucacaagaugucuuauccaacuucucaaaaggggucacgcuaucacaaacaagugaaagaacuucguucagaggagcuagaagacuaagagaacguacucuauuaagaagagaacgccuacacagaauacuacaccuucuagguuuucuucccaaacauuacgaaaaagcaauagguugggaccgcaacgauaacaaaacauauggaaaauucauaaaucaugcagaacccaaacuugcaugguguaaagacaacaacggaaaaaugagguuccuauuuauggauucauuccaugauaugcuauccgaauuuucugaaaaacacccggaacuccuagccaacgguaagaaaauaccauuagauuggacaaucuauuaccuuaggaagaaagcccucuauaaagcgauuacaaaagaagaauuagcauggauacuacuaaacuuuaaccagaaaagagguuauuaucaacuuagaggagaagaagaccgggauuccgaagccaacaagaaagaauaucuagaauuaaaaguaaucgguguagaagcgaccggugagaagaaaggcaacgacauaugguauaauauccauuuagaaaacggcuggauuuaccgucgaucuuccaaaaacccuuuaaaugacugguuaggcaaaguuaaaucuuucauagucacaacagaucuagaugcagauggaaacccgaagaaagauaaagauggaaacauuaaaagaucauucagggcuccaagcgaaggcgauuggacacuaauuaagaaaagaacugaaucccuauuagaaaauagcggccaaaccguagggcaauuuauauacaaccacauauuagaagaacccagugccaaaauaagaggcaacuucauaagaaccauagaaagaaaauacuacaaagacgaacucaaagcuauauuagaaaaacaaaaagaguuccaccaugaauuaucguccgaaagucucuuaacugaaugugcuaaagaacuuuauaaacggaacauugcucaccaagaaguuuuacucaagaaaggaaugauucauuuacuauuaaacgacauuuuauuuuaccaaagaccucuaaaaauuaagaaaagucuaauagacaacuguccauaugaaaauuacaaauacguagauaagaaaagcggagauauuaaaguaaaaagcauaaaauguauugccaaauccaaucccuucuuucaggaauuuagauuauggcaguucguuuccaaucuaagacuauacagaaaaucugaugacaaagaugucacauccgaacaccuugucaccacugacgauuaugccaaucuuuuuaccuaccucaauaaccguaaagacaucaaacaaagcguacucuugaaagaauauuuuaaaauuaaaaagguaaaaaccauaaauggagccgaguacccaguccgcuggaacuauaucgaugaugacaauaaaaccuacccauguaaugaaacgcgauacgacauacuacacgcccuaucuaaaacagaacucaaaucagaauggcucacccccgaacgcacauaucgccuguggcacuuauuauacaguaucgaaucgaaagaagaaacgaagaaagcacuaaacaaacuaaaucucucggacgacuucacagaagcguuucucacaaucaaaccuuucaagaaagaauacgguucauacucugaaaaagcgaucaagaaauuauuaucgcuaaugagaaugggauaucuauggucagaagacgaagcaauaaaacaagucggagcugaaaucgagaaaacaaucgaaggagaacuuccagauuauguccuacaaaggcuugaaaaaucacagcacaauuacaauaaaauaagugacuucucaggccuaccacuauggcuggcaucauacauaauauacggaagacauagcgaagcaaaggaaauuauacauugggacaauccugaaucuaugauggcauauaucaaagauuuccgccaacacucaaugagaaacccaauaguagaacaauguguacuagaaacacuuaggacaguacacgacauauggaaagaaauuggacauauagacgaaauacacauugaacucggacgagaaaugaaaagcaccagugaacaacggaaagccauaacccaaaacguacuacauaaccaaaauaccaacauuagaauaaaacuacuacuucaagaacucaaaaaugauaacaacauaacaggaguccgaccuuacucccccaugcagcaagaaauauugcgaauuuaugaagaaggcgcacuucaagguuuaacgaaagaagacaaagacuauaaugacauucuaaaaauaagccaaacagcacaaccaacuucaaaugaacucacaagauacaaacucuggcuggaacagaaauaucgaagcccuuauaccgguaaagcuauaucacuaaguaaacuauucacuucagcauaucaaauagaacacguuauaccacagucacgcuauuuugaugauucacucagcaacaaagucauaugcgaaucggaaguaaacacacuaaagaaagcaaugcuaggcauggaguucaucaaaacauguggaggacaaaaaguccauugcacacuacuaggggacguagaaauauacaacgaagaagacuacaaagcauucguaaacgaacacuauucaaauaauagaacaaaacguaauaaacuacugauggaagacauuccgcaagaguucaucaacagacagcucaaugauagcagauacaucuccaaaaugguaaaacaauuacucucagccaucguacgcggacaagaagaaguagaagcaacaagcaaauucguaauaccauguacaggaggcaucacagaccgacucaagaaagacuggggcuuaaaugauauauggaauaauuugguaagcccgagauuccaaagaaugaaugcauuaacaggaucugaauauuuuggucauugggagaauaaagaagguaaacgaguuuuucaaacaaccaugccaauacaacuccaacaaggauucagcaagaaaagaauagaccauagacaccacgccauggacgcacucguaauagcaugcgcuucucgaaacauaauaagcuacuuaaacaacgagacggcccaagauaccgaaagaaggcgcgaccuaagacagaaacucugugauaaaggcgggucuguacgaaaaccaugggacaguuuuacacaggauacucaguaugcacuaaaagauauaaucguaacuuucaaaaacuauguaagaauaaucaacaaagcuacuaauuauuaugaacacuacaaaacagauggaaagaaaggcaugaucucacaaaaaggugaugaauuaugggcaauaagaaaaccaaugcauaaagagacaguauucggaaaaguaaaccugaggagaccaaaaagaguuagucuuaguaaagcuauugacagcguagacgucauaugcaacaggaaacuaaagaaauacauaaaagcaaggcuaaacgaaggauuacagaagaaacagauacucaacauuuuuaaagaacuuaacaauguuugggaaggaauagauguuaacaaaauugacauuugggaaaugucaaaugacaaagaaccgaugguagcaacacgaaaacaacuagacacuucauuugaugagaagaaaauaagaagcauaagcgacacuggcauccagaaaauucuacuaaacuauuuaaucaccaaaaacaauaacccagaauuagcauucaccccagaaggcauucaagaaaugaauaguaauauaucagaauacaaugaccauaaagaacaucaaccuauauauaaaguucgcguuaccgaacccuugggcgccaaauauccaauugguacgaugggaaacaaaccgaagaaauucguagaagcacaagcuggcacaaaucuauauuuugcaauauacgaagacaaagaaggaaacagaaauuacgauacuaucccauugaacauugcagcagaacgauugaaucaacagcuuucaccaguaccagaaacaaaugaaaauaacacuccacuaaaauucuaucuaagcccuaacgaccuaguuuauguuccaucagaggaagaacggcauucagggaacaacauccaauuagacaaaaauagaauuuauaaaaugguaucaaguaccucgaaacaaugcuuuuucauccaucaccgaguagcaauaaguuuaguugauaagaaagaguucucagcucaaaacaaaauggaaagaucaaucgacaaugaacaaguaaugauaaaaucuguuuguuggaaacuaauaaccgauagacuagguaauaucauuaagguaaucaaauga

SEQ ID NO: 9205 - RNA, 4461 nt, Artificial Sequence
  Cas9 variant
augacuaaaauacuaggacuggauuuaggaacaaauucuaucgguugggcaauacgagaagacgaaaacgaaggaguaaaucaaauaauagacaaagggguaagaauauucucagaagguguaaaaucagaaaacggaaaagaaauaaguagagccgcugaacgaacagcauaccgaucagcuagaaaaauaaaauauagaagaaaauuacggaaauacgaaacucuaaaaguuuuaucgguaaacggaaugugcccacuaucagucgaagaaguugaacaauggaagaaaaguggauuuaaagaauauccacuaaacccagaguuccuaaacuggcuacgaacaaaugaagauaaaaauauaaacccauacuuuuuccgugacaaagcaaguaaacaaaaagucacauuauucgaauuaggacgagcacuuuaccauaucgcacaacggagaggauuccuaaguaauagauuagaccaauccgcagaaggaguauuugaagaacacaacccacaaauacaaaacuuaauagaagaccuagacucaagcaacacaauauuaaacgaacuuaaagaauauuacaucaaccuagggauaaucgacgaaagugagaaaaguggguucaagaaagaucuugaugaaggagagaaaaaccucaagaaacuauacaccucuuuagucagcauaacaaagaaaaacgcaaaugacauagaaacaugcaaacaagaacuaaucgcaaggcuaaacaagaaagaagaccuuggaaaagugaaaggugagauaaaagacaucucccaagccaugcuagauggaaacuuuaaaacccuaggccaauacuucuuuagucuauacaacaaaacgcgcauccgaaaccaauacaccagucgagaagaacauuaucuugaagaauuuauaauaauuugucaaacacaaggaaucgaggaaauaaauacuaacgaaaaauuaccugaaaagaaauuuacaggauuggcaaaagaccuauacagggcaauauucuuucaaagaccacuuaaaagccaaaaaggacuaauagguaaauguucauuugagaaaaauaaaucgagaugugcuguaagucauccagauuaugaagaauuucgaauguggaguuaucugaauaccauaaaaauuggaacgcaauccgagaaaacuuuaagauucuuaacauuagaagaaaaacugaaacucguaccuaaauucuaucguaaaaaugauuucaacuuugaaguacuagcuaaagagcuagucgaaaaaggugcgucauuugguuauuauaaaucuagcaagaaaaaugaauuuuucuauugguuuaacuacaaaccaacugacaguguaagugcuuguguaguaucggcuucacuagaaaacgcaaucggaaaagacuggaaaacaaaaacguuugaauaucaaacgagcaauaccaagaaagaagaaguaacaaaaucaguaaacuacaaagacuuauggcaucuacucuccguagcaacauccgacacauacuuauacgacuucgcaauugaaaaacugaaauuggaacccaaaaaugcuaaagcauuuucaaaaacaaaacucaagaaagacuucgccagccuaagucuugccgcaauagccaaaauuuugccauacuuaaaacaaggauugcuauacagccaugcuguuuuuaucgcuaauauagaaaauaucgucgaugcagacaucuggaaagauaaagaacaacaaaaauuuauacaaucgaaaauaguugacuuaauagacaauuaucuagucgaaaaaucaaaacucgaaaucaucaauugcuuacuuaaaaucuacaacacagaagauauagaagguaggaaagucuauuacaguaaagaagcugaaucgcuguucgaagcggaccuaagaaagaaauuaguaccguucuacaaagcaaauacaauaagugaacaacaagaacaagaaaucauauuuaaagaccuauuuccggucuuaaucgaacaacucaagaaacaagaauuuauaaaaaucguaagacuggauaagaaaauagaagcauuucuaaaaggcgaaaaugaagaaggccaaauauucugcaauuacccagagaaauucaagaaacuuuaccauccaagugacauagaaguauuuaaaaagaaaauaaucaaagacgaaugggggaacgaaaaagugguccuagggucuccacucacgaccaguauuaaaaacccgauggcaaugagagcacuucaccaguugagaaaagucuuaaauacauuaauacuagacggacaaauagaugagaaaacacgaauccauaucgaaauggccagggaacugaaugaugcaaacaaaagaaaagguauacaagauuuucaaaaagaaagggaagaacuauacaaaauuuacgaagccaaaauaaaagaauuauaucaaguaaaaacaggaaaagagcuacuacacgucacugacgaagaccuacaaaaauucgaaugggcucuagaacaaacaaaagauggacgaaucaucacaaaagaggaauugauaaaauacaaaauaugggaagaacaaaaucauauaugcauauacacggguaaaacgauaagcauagacagcuuccucggcgguaauccaaaguucgacaucgaacacacuaucccgagaagcauaucacaagacaauagucucaugaauaaaacacucugugacaaagauuucaaccgauccguaaagggcaagaaaaugccagucgaacuuucaaacuauaaugaaauacugccaagaaucgcucacuggaagaaacaagcagaagaacucacaagacaaauagaaacaaucagucgaagcauaaaaagugcugcaacaaaagucgcgaaagacaaaaacauucgaaaaagacauuaucuaacacuuaaacgagauuauauacaaggaaaauaugacagauucaccuggggagaacccaaagucggauucaaaaacagccaaauaccugacacuggaauaauaacgaaauaugcgcaagcguacuuaaaaaguuacuucaagagaguugaaucuguaaaaggcggagcaguagccgaauuuagaaaauuaugggggauacaggaauccuucauagacgaaaacggcuuuaaacacuucaaagaaaaagaucgaucaaaacauacccaucacacgauagaugcaaucacuauagccuguaugcccaaagacaaauaugauuuauuggcucacgcauggagacuagaagacgaacaaaacaagaaagccgcaaaagcacuuauagaacaagcaaaacccuggaaaacauucaaggaagauauagagaaaauagaagccgaaauucugguuucacacuuuacgccagauaaugucaagaaacaagccaagaaaauacuaagaguacgaggcaagaaacaauacguagcagaaauagaacguaacgcuaacggcaaagcuauacccaagaaagacgcaagcggcaaaauaauauacaaacucaaugaaagaggcaauaagauaccaauccuucaacaaggcgauacaauccggggaucacuucaccaagacaguauauauggcgcuaucaaaaaccccuuaaacacuaaugaaauaagauacgucauccgcaaagaccuugaaagccuaaaagcaaaugacauagaaaauauaguagacgaaaacguaaaagcgaagguuaaagaagcaguagcgaauaagauauuauuaauuagcucaaauccccaacagaaaaacaaauucgcggaaggcaaaaacguauggaugaaugaggagaagaaaaucccaauaaauaaaguacgaauauaugccaauucagucaaaaauccaaucgaaaucaagaaacacaguacgcuaucgaaaucaaagcacgaacauaaacagaccguauacggccagaaugaugaaaacuacgcaauggcacucuaugaacucgaugguaaacgugaauuugaacuaauaaacaacuucaaucuagcgaaacuuuuaaaacaaggccaaggcuacuauccuuuacacaaagaaaaagagauaaaaggcaagaaagugcuaauacccauagaaaaacgaaauaauagagauguggugcuaaaacggggacaacaagucgucuuuuacgacaaaaccguagaaaauucaaaagacauaagcgaaauugucgauuuuagaggaagaguuuaucucauagaaggucucacgauacaaagacaaaaagauaaaaagacuggaaaaguuaaugaauauggcauuauacaauuaagauacuucaaagaagcuagaaaaagcgaagaaauuucaaaagacucauuuaaaccagacggcgaguucaaaaucaaugaaaacaaaccaacgaggaaaaugaaccacaaccaauucacagcauuuguagaaggaauagacuucaaaguccugccauccggcaaauuccagaaaaucuga

SEQ ID NO: 9206 - RNA, 4464 nt, Artificial Sequence
  Cas9 variant
augaaaaacguacuaggacuagaucuaggaucaaauagcguaggaugggcucuuguuaaaaccgaagacaauggcaauccaauuggaaguauaaaaaugggaaguagaauaauuccgaugucacaagacauacucgguaguuucgaaaaaggagauaccgucucacaaacagcacaacguacgcuauaucgaggcaaaagaagacuuauagaaagacauguacuaagacgagaacgacucuguagaguucuacauauaaugaacuucuuaccagaccacuucgauaaauuacugggaugggacaaaaccgacaauaaaacauauggaaaauuuauagaugacucagaaccuaaacuugcauggcgccaaaauaaaaacgaaaaagagaaaauggaguuugucuuuauggauagcuuucaugagaugcuaucagauuucgcaaaacaccaaccacaauuaauagccaauggaaagaaagugccuuuagauuggacaaucuauuaucuaagaaagaaagccuugacgcaauugauaaguaaagaagaguuagcguggaucuuauuaaauuuuaacaagaaaagaggcuauuaccaacuuaggggagaagaagaagaagaacaaccaacaaagaaagaagaauacaaaguucuaaaaguaaucaguguggacgcagaugaaggucaaaaaggaaacggaauaugguauaauauacaucucgaagacggagguaucuauaaacgcaaaagcgacaccccacuauaugauuggguaggcaaaacgcuucaacuaaucgucguaacuaucuacgaaaaagaugguaaaacgccaaaaaucuucgauuccggcaaacaaaauccaucauauaggcuaccaaaagaagacgauuggggauuaauaaagaaacgaacggaaagucaaauccaaucaucggguaaaacaguaggugcauucauauacgauaauauccuaaguaaaccagacgacaaaauaagaggaaauuuaguccgaacgauagaacgaaaauacuacaagaaagaacuuauugaaauacuacaacaacaagcaaaauaccacgacgaacuucacaaccaaaaucuauuagaaucaugugccaaagaacuguaugcucacaacgacguuagauacaacgaaguagucaaaucaaauaugauucaccuacuuguagaugauauaauauucuaccaacgcccguuaaaaucaaagaaaucgcuaauagcaaacuguaaauaugaaucauacgaguacguagauaaagaaaccggagaaguaaaagagaugccgaucaaaugcauagcaaaaucaaacccauauuaccaagaguuccguuuauggcaguuuauacacaaucuaagacuaucugacgucguaacaagagaagauguaacagcacaauauuuaucaacaccccaagacuauuguaaccuauucacauaccuaaacgauagaaaagaaauuaaacaagacauacuauuaaaagacuucuucaaaauaaagaaaguacaaauagacaaagaaaaaguuuucccaauagaauggaacuacauaaaagaugcuacgaaaaccuauccaugcaacgaaacacgauacgaacuacuaagugcauuaaaaagggcagguauggauaaacaaugguuagacgacacucccaacaugcaauauagguuguggcaucuuuuguauaguguagaggaacaagaagaaucagcuaaagcacuaagaaaacuauaugacaacgauaacuucguguccaguuuccuaaaaaucaaacccuucaagaaaugcuauggcgccuacucagaaaaagcaauaaaaaggcuccuaacacuaaugaggaugggaaaagcgugggaugaacaagcaaucgaugccaaaacccuaaaauguauacaacaaauuauaacaggaaacauagacucaaaacuaaaagagaaaauugaugacucacguuacguccuucaccauguaucggacuuucaaggucuaccgacauaucuugcuaguuacguaauauacgguagacacucagaagucacugauauaagaugcugggacaccccaaaagaccuacuaaaauucauaugcggcuuuccacagcauucauuaagaaauccaauuguugaacaaguaauacuagaaacauuaagggucguauaugacauauggaaagcagaaaaacauauagaugaaauacauguugaaguagcaagagaaaugaaacuuacugcccaacaacgaaacgaagccaaucuaagaaauuuaaauaacgaagcgacuaaccuaagaaucaaauaccuacuagaagaauuaaagaaugacacauuuauaaaagacgugagaccauugucccccaugcaucaagagaaaaugagaauauaugagcaagcgguucucgguaaccuaaauaaacaagauaaagacuacgaugauaucaucaaaauaaguaagaaagaacguccaaccagugcagaacucauaagauauaaauuauggcuagaacaaaaauacugcucgccauauacgggaaaagcaauaaguuugucaaaauuauuuacaaccgcauaccaaaucgaacacguuauaccccaaaguagguacuucgacaauucuuucaacaacaaaguaauaugcgaaucagaaguaaauaaagaaaaagauaaaauguuaggauaugaauuuauaaaaggucgagggggcgacagaauauauugcacggcacauggaaaagaaguaacuauauuaaaagaggaagaguacaaacaauuuguuaacgaacauuacgcacauaacaaaagaaaacgagauaaucuacuugccgagaauaucccugaaaguuuuucaagcagacaacuaaacgacacacgauauauuacaaaaacaauuaugagucuacuaucaaacguaguuaggcaacaaggagaagaagaagcaaccgcuaaaaaccuacuaccaaguaguggggcaguaaccgauaaauugaaaaaugacuggggccuaaaggauguauggaacacaaucguuacuccaagauucgagagacuaaacaaguugagugguaccaacgacuucggugaaaugaaagaagaaaacggaaauagauacuuccaaacuaacguaccaagcgaauaugaaaagggauucaagaagaaaagaauugaccauagacaccacgcaauggacgcauuaguaauagcaugcacaacaagaaauaugguaaacuacauauccaauguaaaugcaaacucuccaaaacaaagagaagaccuccgccaauuacuaugcgacaaaaacagaauuauuaauaaaccauggaauaccuuuacucaagaugcauuaaaagccuuaaaugacauagucguaucauuuaaaaauaauguacggauaauaaaucgagccaccaauagguaccagagauacgacaaaaaugggaagaaaaugaucugcucccaaaaaggcaaugacaugugggcuauuagaaaauccaugcacaaagaaacuguauucggucgcguuaauuuaauaagaaaagaagccuuaccaauugcuaaagcacuagauaacauaucggcgauauguaacgcgcaacuacgagccuauguaaacgacuuaguagacaaacauuucaauaagaaacagcuagucgcacauuuuaaaucacucgacuauaaauggaauaggcaagacgugagcaaaguugaaguauggauuagcucagacgauaaaacaccaaugguugccguacgcaaaccuuuagauacaucguucgauaaaaagaaaauagcaucuauaacugacacaggaauccaagccauuuugcuaaauuauuuggaaucuaaaggcggagaugcucuugucgcauuugcgccugaaggcauucaagaaaugaacuccaauauagaauuauauaacaauggaaaagcucacaaaccuaucaaaaacguaagauuaucugagacacucggagcaaaauaucaagucggcgaaagaggagcaaaaacaaagaaauacguagucgcagauaaaggaacaaaccuauucuuugcuauauacgaagaugaggaaggaaaacgauauuacuacucagucccucuaagagaagcuauagaacgacaaaaacaaaaacucucgccugucccggaauacaacgagaaaggaguagcccuuaaauucuauuugaguccaaacgaucuaguauauguaccaacugaagaggaacguacaaugggaaccugucauaucgacaaaacaagaauauacaaaaugguaaguaguagugaaaacagaugcuguuuugugccuucaacaauagcaaaaguaauagcggauaaagucgaacuauugagucauaacaaaauagagaaagcaauuacaggggaaucaauaaaagaaguaugcuggaaacuaaaaguagacagacucggcaacauacuaaauguaauaaaguga

SEQ ID NO: 9207 - RNA, 4464 nt, Artificial Sequence
  Cas9 variant
augaaaaacguacuuggacuugacuuagggagcaauucaguuggaugggcccuagugaaaacagaagauaauggaaauccaauaggauccauuaaaaugggaagucgaauaauuccuaugucccaagacauucuaggaagcuuugaaaaaggggauacgguaucccagacggcccaaaggacuuuauauagggguaaaagaagacuuacggaaaggcauguccuacgacgugaacgauugugccgugugcuacacaucaugaacuuccuucccgaccauuucgauaaacuacucggaugggacaaaacagauaauaaaacguauggaaaauucaucgacgauucagaaccaaaacuggcguggagacaaaauaagaacgaaaaagaaaaaauggaauucguauuuauggacaguuuucacgaaaugcucucagacuucgcuaaacaccaaccacaacucauugcgaauggaaaaaaaguaccucuagacuggacaauuuauuaucuaagaaaaaaagcuuugacacaacuaauaaguaaagaggaauuagccuggaucuuauuaaacuucaacaagaaaagaggcuauuaccagcuuagaggggaagaagaagaagaacaaccaaccaaaaaagaagaauauaagguacuaaaaguaaucaguguagacgcagaugaaggccaaaaggguaaugguauaugguauaauauacaucuugaagacggaggaauauacaaacgaaaaagcgacauaccacuauaugacuggguagguaagacccuccaacucaucguaguaacaaucuacgaaaaagacggaaaaacuccaaaaaucuucgacuccgguaaacaaaacccaaguuauagacuacccaaagaagaugauuggggguuaauaaaaaaacggacagagagucaaauccagucgucuggaaaaacaguaggagcuuucaucuaugauaacauucuaaguaaaccugcugacaagauaagaggaaacuuagucagaacaauagaaagaaaguauuacaaaaaagaauuaauugaaauucuacaacaacaggcaaaauaccaugacgaacuacacaaccaacacuuguuagaauccugcgccaaagaacuuuaugcacacaaugauguacgauacaaugaaguagucaagucaaauaugauacauuuacuaguagaugauauaauauucuaucaacgaccgcucaaaucaaaaaaaaguuuaauugacaacugcaaguaugaaaguuaugaauacguagacaaagaaaccggcgaaguaaaggaaaugccaauaaaaugcauugcaaaauccaaucccuauuaccaggaauuuagacuuuggcaguuuauccacaaccuaagacuaucagacguggucaccagggaagacguaacugcucaauaucuuaguaccccacaagacuauuguaacuuauuuacguaccuuaaugauagaaaagaaauaaaacaagauauauuacuuaaagauuucuuucagauaaaaaagguucaaauugauaaagaaaaaguuuuuccaauagaauggaacuacauaaaagaugcuaccaaaacauauccaugcaaugaaacaaaauaugagcugcuaagcgcauuaaaaagagcaggaauggacaaacaauggcuagacgauacacccaauaugcaauaccggcuuuggcaucuuuuauauaguguagaagaaaaagaagagagcgcuaaagcacuacgaaaacuauacgaugaugauaacuuugucagcucauuccuaaaaaucaaaccauucgagaaaugcuauggugcauacuccgaaaaagcuauaaaacgccuucuuacacuuaugcgaaugggaaaagcgugggacgaacaagccauugacgcuaaaacccuuaaaugcauccaacaaaucaucacuggaaacaucgauucgaaacucaaggaaaaaaucgaugacagcagauauguacugcaccauguuagcgacuuucaaggacuacccacguaucuagcaucauacguaauauacggcagacacagcgaaguuacagacauucggugcugggauacgccuaaagaucuccuaaaguuuauauguggauuuccgcaacauucacugcgaaauccaauaguagaacaaguaauauuagaaacauuaagagucguguacgacauauggaaggcagaaaaacauauagaugaaauacauguagaagucgccagagaaaugaaguuaacugcacaacaaagaaacgaagccaaccuaagaaacuuaaauaaugaagcuacaaacuuaagaauaaaauaccuauuagaggaguuaaaaaaugacacguucauaaaagacgugagaccauuaaguccaaugcaccaagaaaaaaugaggaucuaugaacaagcuguucuuggaaauuugaauaaacaagacaaagacuaugaugauaucauaaaaauuuccaaaaaggaaagaccaacaagugccgaacuuauacguuacaaacuauggcucgagcaaaaauauugcaguccauacacaggcaaggcaauaucacugucaaaacucuucacuaccgcuuaccagauugaacauguaauaccgcaaucacgcuacuuugacaacaguuucaacaacaagguaauaugcgaaagcgaaguaaacaaagaaaaggauaaaaugcucggcuacgaauuuauuaaaggacgaggaggagauaggauuuacugcaccgcacacgggaaagaaguaacaauucucaaagaagaagaauacaaacaauucguuaacgaacacuacgcacauaacaaaagaaaaagagauaaucucuuagcagagaacauaccagagagcuucucaucaaggcaacuaaaugauacuagauauauuacaaaaaccauuaugaguuuauuaucaaaugucgucagacagcaaggagaagaagaagcaacagcaaagaacuuauuaccuaguucaggcgcaguaaccgacaagcuaaaaaacgauuggggauugaaagauguauggaacacuauaguuacaccaagauucgaacgauuaaauaaauuaucaggaacaaacgauuucggugagaugaaagaagaaaauggaaacagauacuuccaaacaaauguuccaucagaguaugaaaaaggcuucaagaaaaaaagaaucgaucaccgacaucaugcuauggacgcccuaguaaucgcaugcacaacacgaaacauggucaauuauauuucaaauguuaacgcuaacucuccuaaacaaagagaagaccuaagacaauuacuuugugacaaaaaucgaauaauaaauaaaccauggaacacauuuacucaggacgcauuaaaagcucuaaacgauauaguaguaucauucaaaaauaaugugagaauaauaaaccgggcaacaaacagauaucaaagauacgauaaaaauggaaaaaagaugauaugcagucagaaagggaaugacaugugggccauacgaaaaagcaugcauaaagaaacagucuucggaagagucaacuuaauaagaaaagaagcacuaccaauugccaaagccuuagauaacauuagugcgaucugcaacgcccaacuuagagcuuacgugaacgauuuagucgacaaacauuuuaacaaaaaacaguugguagcacacuucaaaagccuagacuauaaguggaacagacaagacguuaguaaaguagaaguauggauaucaucagaugauaaaacacccaugguagcagucagaaaaccacucgacacaucguucgauaaaaaaaagauagccucgauuacagacacaggaauucaggcaauucuauuaaacuaccuagaauccaagggcggugaugccuuaguagcuuuugcuccugaagguauacaggagaugaacagcaacaucgaauuauacaacaacggaaaagcacacaaaccaauaaaaaacguaagacucagugaaacuuuaggugcgaaguaccaaguaggcgaacgcggggcaaaaacgaagaaauacgucguagccgacaaaggaacuaaucuauuuuucgcaauauaugaggacgaggaaggcaaaagauacuacuauucggucccucuaagggaagcgauagaacgccaaaaacaaaaacugucaccgguuccagaauauaaugaaaaaggaguugcauuaaaauucuaccuaagcccaaaugaucucguuuauguaccuacugaagaagaacgaacgaugggcaccugccacauugauaaaacaagaaucuacaaaauggugaguuccucugaaaaccgauguugcuuugucccaucaacaauagccaaagucauagcagacaagguugagcuacuuucucacaauaaaauagaaaaagccauaaccggagaaucaaucaaagaaguaugcuggaaguuaaaaguagaucgucuagggaacauauuaaauguuauaaaauga

SEQ ID NO: 9208 - RNA, 4464 nt, Artificial Sequence
  Cas9 variant
augaaaaacaucuuaggccuagaccuuggaaguaauucgguagguugggcauugguuaagguagaagagaaugguaauccuauuggcagcauuaaaaugggaagucgcauuaucccaaugucucaagauaucuuaggcucguucgagaaaggagauacuguuucucagaccgcucaaagaacccuauacagagguaaacgaagauuaauagaaagacauguucuaagaagggaaagacuguguagaguacugcauauaaugaacuuuuuaccagcccacuuugacaggcuccuaggcugggacaaaacagauaauaaaaccuauggaaaauuuauagacgauagugaaccuaaauuagcguggcgacaaaacaagaaugagauggggaaaauggaguucguauuuauggacucauuucacgaaaugcuauccgacuuugccaaacaucagccacaacuaauugcaaacgguaagaaaguaccacuagacuggaccaucuauuaucucagaaagaaagcccuaacacagcuaauaaguaaagaagaacuagccuggauacuacuaaauuucaacaagaaaaggggguacuaucaauuaagaggagaagaggaagaggaacaacccacaaagaaagaagaauacaaaguacuaaaagucauaucuguggacgcugaugaaggucaaaaagguaacggaauuugguauaacauacauuuggaagauggaggaauauacaaaaagaaaagugauauuccauuauacgacuggguuggcaaaacccuucaauuaauagucguuacaaccuaugaaaaagauggaaaaaccccaaaaauuuucgacucaggcaaacaaaauccaucauacagacuuccaaaagaagacgauugggggcuaguuaagaaacgaacagaaucucaacuacaaagcucgggaaaaacuguaggagcauuuauauacgauaauauucuaaguaaaccagacgacaaaauaagaggaaaccuaguacgaacgauugaaagaaaauacuacaagaaagaauugauagaaauucuacagcaacaagcuaaauaccacgacgaauuacacaaccaaaacuuacucgaaucaugugcuaaagaauuauacgcacauaaugauguacauuacaacgagguaauaaaaaguaacaugauaaaucuauuaguaaacgauauaaucuuuuaucagcgaccccuaaaaagcaagaaaucccuaauagccaauuguaaauaugagucuuaugaauacguggacaaagagacaggagaaauaaaagaaaugcccauaaaaugcauagcgaaaucuaacccauacuaucaagaauuuagguuguggcaauucauacacaaccucagacuaucagacgucgucacccgggaagaugugacagcacaguaccucucaacaccgcaagauuauugcaaccuguucacauaucugaaugacagaaaagaaauaaaacaggacauacuccuaaaagauuucuucaaaaucaagaaaguccaaauagauaaagaaaaaguuuucccaaucgaauggaauuacauaaaagacgcaacuaaaucauauccauguaacgaaacacgguaugaacuacuaagcgcguuaaagagagcaggaauggauaaacaauggcuagaugacacaccaaacaugcaauaucguuuauggcacuuauuauauucuguugaagagaaagaagagagugcaaaagcacuacgaaaauuauacgacgacgacaaauuuguaacaucuuucuuaaagauaaaaccauuuaacaaguguuauggagcauacagugaaaaagcuauaaaacgacuccucacuuuaaugaggaugggaaaagcauggaaugaacaagcaauagaugccaaaacacuaaaauguauacaacaaauaauaacugauaauguugacucaaagcugaaagagaaaauugacgacucgcgcuacguauuacaucaugucucugacuuucaaggucuaccaacuuaccuagcaaguuaugugauauacggacggcacucagaaguaacagauauucaauguugggauucacccgaagaccuccucaaauucauaagagacuuuaaacaacacagucuaagaaacccaauaguagaacaaguaauuuuagaaacacuaagaguaguauaugacaucuggaaagccgaaaaacauauugaugaaauacauguggaaguagcaagggaaaugaaacuaacagcacaacaacgcaaugaagcaaauuugaggaaccuuaacaacgaagcaacaaauuuacgaauaaaauauuuauuagaagaacuuaaaaacgacaccuucauuaaagauguuaggccacuuucuccaauucaccaagaaaagaugagaauauacgaacaagcaguuuuaggaaaccuaaacaaacaagacaaagacuaugacgacauuauaaaaaucucuaagaaagaacaccccacaaaugcagaauuaauaagauacaaauuaugguuggaacagagauauugcucuccuuauacaggaaaagcaauauccuuaucuaaauuauuuacuacagcauaugaaauagaacauauuauaccacaaagucgcuauuucgacaacuccuucaauaacaaagucauaugcgaagcugaaguaaauaaggcuaaagggaauauguugggauacgaauuuauaaagaaacagggaggccagaaaauauacugcacgcaacuaggaaaagcuguaacaauacuaaaagaagaagcauauaaacaauuugucaacgaacauuacgcacacaacaaaagaaaaagagacaaccuacuagccgaaaauauacccgagagcuuuuccucacgacaauuaaacgacacacgcuacauaacuaaaacgauaaugagucuucuaagcaacguaguaagacaacaaagugaagaagaagcuacggcuaagaaucuacuacccucaaguggaagcguaacagacagacucaaaaaugauuggggauugaaagauguauggaacaccauaguaacucccagauuugaaagacuaaacaaauuaucuggcacaaaugauuucggcgaaaugaaagaggaaaacggaaauagauauuuucaaacuaauguaccccuagaauaugaaaaaggcuucaagaagaaaaggaucgaccaccgacaccacgcaauggacgcauugguaauagcauguaccacucgaaacauggugaauuacauuagcaaugcaaacgcuaacaguccaaaacaaagagaggaccuaaggcaauugcuaugcgauaagaaucguauaauaaacaaaccaugggacacuuucacacaagacgcguuaaaagcccuaaaugauauaguaguaaguuuuaaaaacaauguacguaucauaaacagggcaaccaaucgguaucaaagauacgauaaaaacggcaaaaagaucaucuuuucucaaaagggagaugauaugugggcgauaaggaaaagcaugcauaaagaaaccguuuuuggaagaguaaaucuaauuagaaaagaaguccuaccaauagcaaaagcccuagacaauauaucggcaauauguaaugcacaauuaagagcauacgucaacgaucuaguagauaaacacuucaacaagaaacaacucgucgcacauuucaaaucauugaauuauaaauggaauaggcaagaugucucgaaaguagaagucuggauuagcagcgacaauaaaacaccuaugguagcuguaaggaaaccuuuagauacaucauucgacaaaaagaaaauagcaagcauaaccgauacgggcauacaaacaauuuuacuaaacuaucuagagaguaaaggaggugaugccaguguagcauucgcuccugaagguauacaagaaaugaacagcaacaucgaauuauauaacaauggcaaagcucauaaaccgauuaaaaaugucagauuaucagaaccccuaggugcaaaauaccaaguaggagaacguggagcaaaaacaaagaaauaugucgaagcagauaaagggacgaaucuuuucuuugcgauuuaugaagacgaggaaggaaaaagguacuauuauucaguaccccuacgagaagccauagaaagacaaaaacaaaaauuauccccaguacccgaauacaaugaaaaagguguagcauuaaaguuuuaccugucaccaaacgauuuaguauaugucccaacagaggaagaaagaacuauggguacaugucauauagauaaggccagaauauacaaaaugguuuccagcacgggaugcuccugcuauuuuguacccuccacauucgcuaaaguaauaguugacaaggucgaacuacaaucauugaacaagauggaaaaagccauaacagaugaaugcauaaaagaaguuuguuggaaacuaaaaguggacagacuaggaaacauaauuaauguaauuaaauga

SEQ ID NO: 9209 - RNA, 4485 nt, Artificial Sequence
  Cas9 variant
augaaaaauauacuaggguuggauuuaggaacaaauagcauuggaugggcccucaucgacaaugaaagucauagaauuauaaagagcggaaguagaauaauccccauggacgcagcaacuaugggugauuacgaaaaaggaaaccuaaaaucggccgacuggaaacgaacauccuuucguggcaugcgaagauuguaugagagagccaaauuaagaagagaacgcuugcuaagggucuuaaauauauuaggauuucugccagaagaguuucgaagacaaaucgauuuugaacaccaccccgggcaauucauagaugggaaagaaccacuaauagcauaccaucacgacgaaaauggucaaagaguuuucagcuacaugagcgccuucgaagaaauguuaacagacuuucgagcaacacaauccgaacucguaagagauggaagaaggguuccauacgauuggacaaucuacuaccuaagacacaaagcauugacacaaccuguaacaaaagaagaauuagcauggauaauacugaacuuuaacacgaaaagaggauauuaucaauugagaagugagagcgaagagguaaccacuaacaaaaacgaagaauaugcagaauuaaaaguaguaucgguagagaaaaccggcgaagacaagaaacgagcaggauauuacugguauacaauaacuuaugauaaugaagcagaacagaaaaucaccagcacaauuccuccccgacaaaucggagauaaagucgaauuaauagugacaacagcgcgagauaaagcuggugaaauaaagaaaucggucagaucccccaaagaggaugacuggacucucaugaaaaagagaacagaacauaacauagaagaagaggaauguacaguuggaagcuacauauaucaacacauccuagcagacccaaccguaaaaguacgaggcaaauuaguacacacuauagaaagaaaauucuauaaaaaggaacugaaacaaauacuuaacaaacaaaaagaguucauaccugaacuccaagaugccagucuauaugaagcauguaucaaagaauuauaucguaacaaugaagcacauauacaaucuauagcaaauaaagacuuuacugaucuauucguuaaugacauaauuuucuaccaacguccucucaaaucaaagaaaaguacuauaaguaacugcccuuaugaauccuauuacuacaaaaacaaagaaacaggagaauuaaucagaaaaccaauaaaaugcauagccaaaaguaacccucucuaucaagaauuuagacuauggcaauucguacacaaucuaagaauauauaagaaaagcgaagaagugucaggaagacuccaaacggaugucgacguaacugauagauuccuaacaacgccagacgauuaugcaaaacucuuuucuuggcuaaaugaucgcaaagaaaucaaacaaaaagaacuucucagauacgaagcauuuggauuaaguaaauccuacggagacuaccgauggaauuuugucgaagacaaacccuaccccuguaaugaaacacuccacgaaauaaaccguagaaugaaaagcauacuuagcgacaaaaaguuaucaagcgaggcauaucaacaauuauggcauauauuauauucuauugacgacccaauagaaaucagaaaagcacuaacuucauucgcucaaaaucaagaaaucaacucagaugauuucguaaacgcauuuuaccaauacguuccagaaaagacaaaaucauauggugcauacagugaaaaggcaauaaagaaacugcuaccucugaugagacgaggaagcuacugggcaauaggcaacauagaugagaaaacacaccguagguuagacaauauuauaaacggcgucgcugaugauagcauaaguacuuguacgcgcgaaaaacuuaacaacuuaaccgacauaacuaugugccaggggaugccuuuauggcaagcauguuacgccguauacgacagacauucagaagcggcagacacuacgaagugggaacaaccagaugauauugauaccuacuuauccacagaacucaaacaacauagucuaagaaacccaauaguagaaacaguuauuucagaaacacugagaguaguaagggacaucuggaaagcauauggcaggcccgaagaaauacauguagaacuaggcagaaaccuaaaacaagaugcaaaaucuagaaaacaagaugcuauacgcauggcagaaaaugaacaaacgaaucuuagaauacgcgcacuauugcaagaacuaucaaacccugaaugcggagucgaaaacguaaggccacacagcccgucucaaauggaauuacuaaaaauauaugaaaacgaaguauugcaaucaaccgacgauauuccugaagaaauaaguaacauaaucaaagacuuaggcaaaacagacucaaagaaaagaccaagccugucagauauuaccaaauauagauuaugguuagaacaaaaauaucaaucacccuauacuggacauauaauuccauuaucaaaacuauucacaccagccuaucaaauagaacauguaaucccacaaaguagauauuuugacgacucgauuucgaacaaaguuauuugugaagcggaaguaaauaaagaaaaagacaggauguuaggauaugaauuuauaaucaacaagggcggcaguauaguuaaagguucauucggacaacaauuuaaaaucuuugacaaaguccaguaugaagauuucguaaagcaaagauacgcucacaacaaaacuaaaaugaagaaauuacuaauggacgacauuccggauggauuuauccaaagacaacucaaugauucucgguauaugucaaagaaaauaauaaguaucuuaucaaacauaguaagagaagauggagaaaaagaagcuacaaguaaacauauaauaguaacaaguggagcaauuacagaccguuugaagaaagaauggggaauaaaagacguuuggaaugauaucauagcgccaagauucaaacgcuuaaauaaauuaaccgauagcaacaauuauggcauggaaacggagaaagaaggcagacaauacuuccaaauuaacguaccaacggagcuaucaacaggccuaaucaagaaaagaauagaccacagacaucaugcaauggaugcuauaaucaucgcuugcacgacaaggaaucauguaaacuuuuuaaauaacucaaccgcggcaucagaccaaaaagauauaagaagggaccuacaacacacucuauguacuaaaaccaaaacagauagcaacgguaauuaugucuggcgguucaauaaaccaugggacacauuuacacaagauacacgacaagaguuagaagggauuauaguguccuuuaaacaaaaccuacgaauaauaaacaaaaugucaaacuacuaccaacauuacguugacggaaggaaaacgauaaguagacaaaacaaaggagauggaugggcaauaagaaaaucauuacauaaagcgacagucagcggaaaaguaaaccuaaaaagaaguaaaacaguuggauucaaagaggcuuuaaacgauuggagcgccauaaaagacaaaacaucuaaagccauacuacagaaaauaauagcccaauacaaaaacuacgauccgaagacaauauuuaaauauuuuaaagaccguaacuuuaaagucgaaggaaaagauuuuaguaaacuugaaguauacuacaauaccagcgauaaagaaccgaugucagcucaucgaguuaacauagacacuacuuuugaugaaaaagagauccgcagcauuacggacaccggaauacagaaaauaauguuaaaacaucuacauaccuacgaugaugcacaaggaaaaacccacccugaagcagcauuuagucccgaaggcauagagaaaaugaaccaaaacauacgaaugcuaaacggagguaaagaccacaaaccaauauucaaaguaagaaaagcagaaaucuuaggcaugaaauucgccgugggcgaacguggacacaaagauaagaaauggguagaagcagauaaaggcaccaaucuauuuuucgcaauauacgaauccgaagaaaauaaaagaucauacaguagcauuccacuuaacgaagccauagauaggcuaaaaagaggagaaaacauagcagacgaaagagaccaaaacggaaauaaacuccucuuuguacuaucuccaauggaucuggucuauguaccagauccagacgaugcacauauagacgaagugaaagguaauaauaauaucuucaaaaugguauccugcacuggaacagaauguuacuuuguuccggaaacuuaugccaacguaauaugcaaaggaaaggaauuagaaagcaagaacaagguugaaagcuaugauggaauaaauaucaaaaagucaugcuacaaaauaaccguagauagacuugguaaaguucggaaaauauuuaaaggauga

SEQ ID NO: 9210 - RNA, 4491 nt, Artificial Sequence
  Cas9 variant
augaaaacuauauugggguuagaccugggaacaaauucaauaggaugggcaaaaguuugcguagacgacaacggaaacuaucucagagauauaaaauuaggaucuagaauuauuccaaugucgcaggacguacuaggaaacuuugauaaaggcguaacagaaucccaaaccucaguccguacuggcuuucgcgggguaagaagaaucagagaaagaucacuauuaagacgagaaagacuccacagaguauuacauguacucgguuaucuaccaccacacuaugacagugcuauagguuggaacaaaaacgaaccuaguacuuacggaaaguuccuaaaccacggagaaccuaaacucgcuugggaacauaaagaagauggaaguaugcgcuucuuguuuauggaaucauuucaugaaaugauggcagauuuugcaaaaucgcaaccaucacuggugucagacggaaagaaaaucccucuagauuggaccauauacuaucuaagaaagaaagcauuaagccaaccaauaaggaaagaagaacuagcauggcuuuuacuaaacuuuaaucagaaaagaggguacuaccaacuacgaggagaagaagacgacgauaauccaacuaaaugcgaggaauacuaugaauuaaaaguaguuggaaucgaagcagaugaagaaggcaaaaauggaaacacuugguauaacguuaaacuagaaaauggauggauuuauagaagacaaucgaaaauuccucuugacgacuggauagggaaaguaagagaguucaucguuacaaccgaauacgaaaaagacggcaucaccuuaaagaaagacaaaaacggugauguaaaacguagcuuuagaagcccaagugaagacgauuggggacucagaaagaaaagaaccgaaaaacuguuagacaguaguaaaaugacaguaggagcuuuugucuacgaccacuuacuagccgaaccaagugauaaaauaagaggaaaauuuauacgaaccauagaaagaaaauacuacaagaaagaacuguaugcaauacuaugugaacaaucaaaauaucacgaagaauuaagaucaggggacuaucuaaauaaaugcgcagaagaacuauauaaaaacaaccaaccccaucgaaacuccuugcuuaccaaagaccuagcauaucuccuccuugaagaccuaauauucuaucaaagaccacucaaaaccaagaaaucauugauugcugaaugucccuacgaagcauacaaauaugucgauaaagaaacaggagaaauaaaacgacaaggaauaaaauguauagccaaaagcaauccguacuaccaggaguuccgguuauggcaguuuauaagcaacuuacgcuuauuuaauaaagcagaugauaaagaaguaacggcugauuaccucccaacacaagaugacuauguccgucuauuugccuaucuuaacgaccgaaaagaaauaaaccaagaaacccuacuaaaagaauuuuucaagcuaaagaaaauuacgguuaauuccgaaaaaguuuucccaauaagauggaacuauauagaagacaaagaaaagaaauauccaugcaacgaaaccagacacgaacuauuacucgcgcuagauagagccagaauagaccacucuuggcuagaaaaaccgggacaagaauaucgauuauggcaucugcuauauucaguugaaaguaaagaagagacaaaagaagcacuucgaaaauuaaaagaugaugacgcauuuguagagucauuuuuaaaaguaaaaccauuuaaacgggaauauggugcauauucagaaaaagcuauuaagaaauuauuagcaguaaugagaauggguaguuuguggagagaaacagacaucugugauacaaccaaaggaaauauaacgaaaaucuuacaaggcgaaauagaugaaaaacuaaaagagaaaauaucagcaucaguuaguaguuauaaccaacuaagugauuuccaaggccucccugucuggcucgcauguuacguaguauauggcagacacagcgaagcugcagaaauucagcacuggaaaaccccggaaucacuuuuagcuuacauuaacgguuucaaacaacacucccuuaggaaucccauugucgaacaaugcauacuugaaacacuaagaacaguucacgauauauggaaagaaguuggacauaucgacgaaauacacgucgaauuaggaaggaacaugaaaaguaccgcagaucagcgagcccgaauuucugaaaauguucucagaaacgaaaauacaaaucucagaaucaagaguuuauuguuagaauugaaaaacgaccccaauaucaaagauguaagaccauacagcccgaugcaacaggagaaacuacgaaucuacgaggaagguguguugcaagaauuaacaaaagacgauaaagacuuuaccgaaauaaccaaaauuaguacuauggcccagcccagcgcuaaagaauuacaacgcuacaagcucuggcuggaacaaaaauauagaucaccauacacuggaaagagcauaucgcuaaccaagcuauucaccagcgcguaccaaauugaacacguaaucccucagucucgauacuucgacgacaguuucaguaauaagguaauuugcgaaucagaaguaaacucauuaaaagauaacaugcugggauacgaguucaucaaaaaccacggcggagaaauuauacauuguacaauguuaggagacguaaagguacuauccgaaucagaauacaaagcauucgugaacgaccauuaugcacauaauaaaagaaaaagagaaaauuuauuauuggaagauauaccccaagaauuucuaaaucgucaaaugaacgacagcagauacauaagcaagguaguuaaagcccuauugaguaauauuguacgagccgaaggcgaagaagaagcaaccaguaaauucguaguaucaugcucaggaggaauuacugaccgucucaagaaagacuggggacuaaaugauguuuggaacaaaauuguauacccaagauucgaaagacuuaauagacuaacuggaacggaggcauucggacaaugggaaaauaaagacggaaaacgaguauuucagacugcaguuccacucgaauuacaaaggggauucaacaagaaaagaauagaucauagacaccaugcaauggacgcuuuaguaauagccugcacaucacgaaacauaauaaacuauuugaacaacgaaucggccaacaacccaaagaaacgcgaagaucuucgacagaaauugugcgauaaaaacagaaccaucagaaaaccaugggaaacauuuacacaagacgcuacagcggcacucgaagacguaaucguguccuuuaaaaacuauguucgaaucaucaacaaagccacaaacuauuacgagagauaugauguagaagguaagaaagucauugcagaacagagaggugaugauaugugggcgauccgaaaaccuaugcaugaagcgacauacuauggacgggucaaccugagacguaaaaagaaaguaaaccuacgcguugcacuugaaaauauuucaucuaucugcgacaacaaacuacguaucuacauaaacggcuuaguagaaaaaggauuuaauacuaaacaaauacuagauaaauucaaaaauacaaacgaccacuuuucaaugcagaaaauagauaaaguagaaauauggcaauucacaaaugaagaagaaaaacugguugcaacaaggaaaccacuagacacaaguuuugauacuaagaaaauagcaaguauaacugauacuggaauacaaacaauucuacuaaacuaucuggaaacaaaaggcggcgacucuacaauagcauuuaccccagaaggaauaguagaaaugaaccaaaauauaucaaaauacaacaacgguaaagagcauaugccaauuuugaaaguuagacuauauacaaaauuagguaagaaaauuccagucggccaaaccggauguaaagcuaaacaauucgucauagcggaagcagguacaaaucuguauuucgcaauauaugaagaugaagaagguaaaagaagcuaucgcacgaucccacucaaugaagucguagaacgucuaaaacaaggacuaucaccaguaccugagaaaaaugacaaagacguccauuuaaaauuuuacuugucaccgaacgaccuuguauacguaccaauagaagacgaacacgaaagucucgcaaaagaucacauauauaaauucguggauucaaguggaacgacugcaaauuuuauaccccauagaagugccaauguaauauuugaauuaaacaagaaagaugcagaaaaauucuguaguggcucaauaauucaaaaugaauauggggucggcaguucccaaagcaaaaaucagaaagcaauaacgggugaaaugauaaaagcgguauguagaaaauuggaaguggaccgucucgguaauguaauaaaagucauauga

SEQ ID NO: 9211 - RNA, 4497 nt, Artificial Sequence
  Cas9 variant
augaagcacauacucggacuagauuuaggcacuaacucaauaggaugggcaguuaucagagcucaccaagaugcagauggacauacaacacuacaagacauacuugcagccggaagccgaauuauaccgauggaugccgcaacauuaacagauuucgauaaaggaaacgcgagaagcgguacagcagaaagaaccucauuucguuccaugcggagaaggcgcgaacgacaacuauuacgaagagaaagguuacacagaguucuaaugcuacuagguuucuuaccacaacacuaugcuaauucucucacaagauauggugaguucgccgauaaccgagaaugcaaauugccauggguaaaagaugaaagcgacggaaaauaccacuuuuuauuucaagaugcguuucacgaaaugugugaagauuuuaggcaguuggcgccacaauggguagcagacgguaaaaaggucccauaugacuggacucuauacuauuuacguuguaaagcucuaagccgaaaaaucagcaaagaggaacuugcauggauccuccuuucuuuuaaucaaaagaggggauacuaucaagcaagagaugaagaagaugaaguaacaacaaauaaacuagaggaauacuacgcaggaaaagucguccgugucgaugacaccggagaaagaaaagggaaaaauguauacuaugauauuacucuagaaaauggauggguauaucguuacgccgcacgaaucuauccugauuggguaggacaaguuaaggaguucauugugacaacuacacuaaauccugauggaacuccaaaaacugauaaagcuggugaagucaagcgaucuuuccgcaugcccaaagaugaugacuggacauuaauuaaaaagaagaaagaaagggacauagauaggucacaagaaacaauaggacaauauauauaucaugcacuccuaaaagauccaucccagaaaauucgugguaaauuaaucggcacaguagaacgaaaauacuauaaagaugaacuacgaagaauacucgacaggcaaauucaauuccacccagaacuccgugaccgagaacuuuacuaugcauguuuacaagaauuauaccccucaaacguggcauucagaaauacgcuaguuaaucgagacuucacauacuuguuccuagaugacauacuauucuaccaacguccacucaaaagcaagaaaucccaaauaucggauugcccauacgaagaacauuucuauacagauaaagaaacaggagaaagaauuagcgucccagucaaauguaucgcugucucacauccacucuaucaagaauacagauuauggcaauucauacaaaaccugcgcauauauuguagagaagcgcgaauagacgguaacuuaaugauugauugggaaguuacaaaugaacuacuacaaacugaagaagauaaaaccgcauuauuugacuggcuuaacgacaaagaauccguaaaacaaccugaacuuguagcauuccuauuaggaggaaaagcuaacaagaaacaaaucaaagcguauagauggaauuauauggacgacgacacaaaaggauacccgugcaaugaaacacgcgcuucauuauuaaaauaucuacgugaggcucaaacagauagcucauuucuaacacgagaacgagaagaagcucuauggcauauuuuauauucgauaucggacaaaggagaacuaaaaagcgcuuuagguaaauucgccguuaaacauggacuaaaugaacgauuuguaacuguauucucaaaauucccacccuucaagaaagacuaugguagcuauucugcuaaagcucuuaagaaauuacuaccacuaaugcguaugggccaucacuggcaagaagcuagcuuuauaccaaguacaagacaacgcauggagaaauucaucaacggugaauacgaugacucaaucgacaaaagaacauacgagaaacucgaaucucuaaccgaaguaucacaauacagagguuugccaggauggcucgcaugcuauguaguauaugaccgacauucggaaggacgagauauagaaagguggacuucaccgucagauaucgacagcuaucuagcacaauucaaacaacauucacuucacaaccccaucguagaaagaguaguauuagaaacacuacguacgguucgagauauuuggaaacaaguugaucacauagaugaaauacacauagaacugggacgcaacaugaaacuaccagcggauaaacgacgacaaaugacagaacaagcauggaaaaacgaacaaacaaauuugagaauuaaagcccuauuacuagaguuugccagacccgguuaugacaucgaaaaugucagaccauacagcccauaucaacaagaucaacugcggauauacgaagaagcaguucuuggcgcaaacgaaugcccugaugauaucagugcaauauuaaagaaauucaauggcuuaaacccaccaacaagcgcagaaguuuuaagauauaaaugcuggcuagaacaaaaauacaggucacccuacacuggcaggaccauuccuuuaaguaaacuuuuuacuagcgcauacgaaauugaacacauaaucccaaaacaaagauauuucgacgauaguuucucaaauaagguuauaugcgaaagcgaaguaaauaagaagaaaggugcaaugcuagguuacgaguuuauuaaaucguaccauggggcaucuauaacauuaaaucgaggcgguacagcaucaauauuuucaguggaggcauacgaaaacuuuguaaaagaacauuacgcucacaacagaggaaaaaugaagaaauuacuuauggaugauguaccagauucguuuauaucuaggcaacuaaaugacaguagguauauaaguaaauuaaugaaaucaauacuaagcaaccuaguacgagaggaaggagaaaaagaagccaucaguaaaaaccuuauaguuugcaccggugggauaacagacagacuaaagaaagacugggguauacaugauguuuggaacgauauaauuuuuccacgauuuaaacgguuagaugaaauggauagcucacauacauacaucacuuuaaacacccaucgacauccgauuccgucuaugccacuagaguuucaacgagguuuuucaaagaaaagaauagaucaucgacaccaugcaauggaugcuauaguaauugcaugugccacaagaaauauagucaauuaucuuaacaaugaaagugcacgacaugaugcaaaaacaagucgaauggaccuucaaaggcugcuauguacggcaaauagaaaacucauagauaaaccuuggaaaacauuuacgcaagacacaugcaaaguacuagaagacaugauaguaucauuccaaagaacacuacggauaauaaacaaaacuaaaaacuacuaucugagauuugaggacgguaagaaaagaagggucuuacaaaccaaaggagauaacugggcaauaagaaaaccacuucauaaagaaacauucuacggagaaauaaauuuaagacgaauugaaacuuuaucucuaaacaaagcgcuagaacguauaccagacaucguagagagagauuuaagaaagaaacuuucagaacuacuuagccucggguacaacgcaaaaagaauaaaaggauauuuugaagaacauaaagaagaauggucagacgugaaucuaaguaaaauaaaggcuuacuacuucaccaaacagaaaaauaaaagauauuucgccgcaagaaccgaacuugauacuuccuucaauaaagauaaaaucgaaaauaaaaucgcagacacagcaauucagaaaauacuucuacaacauuuagaagcauacggaaacgauguagaacaggcuuuuucacccgagggaauugacacaaugaauagaaacauuagacaacucaauggagguagaucacaccaacccauuuacaaaguaagaguauacgaagaagccacaaaauuugcagucggccgaagagggaacaaaaguacaaaauuuguagaagcagccaaaggaaccaaccuauuuuucgcuauauaugaaaucagccaaguagauggaaauggaaaccggcaaacaucgagaacauuuucaucuauaccauuaaauguagcaguagaacgauuaaaacaaggauuaccacccguaccagaagaugaagaaggaaacgcuccaaaauacguucuaucacccaaugaucuaguauacuuaccuacagaaaaagagcucaaaagaagagaaauugcaaugccaauagauaaaucgagaaucuauaaaaugguaagcuguacuggcaaagauugcuucuuuauacccgcgaacacugcggugcccauaguagauagauaugaauauuccucaaugaacaaaauagguagagccuuaacgggcgaaaugauaaaggaaaucugucuaccgcuaaaaauagauagacuaggacaaauuauugaaaucucuacuuucuga

SEQ ID NO: 9212 - RNA, 4506 nt, Artificial Sequence
  Cas9 variant
augaagaaaauauuaggccuagaucucggaacaaacucaauaggcugggcggucaucaauaaagcugaaaacgaaggaaaagacguacuaugcgguauugaagcagcaggaucaagaauaauccccauggaugccacgauaaugggagacuucgaaaagggaaacucagugucacaaacaaaagacagacgagagcacagaucaaccagaagacuauacgaacgaggcaaacuucgaagagagagacuuaacaggguauuaucaguuaugggauuccuaccugaccacuaugucucucaacucgacagauacggaaaauuccucagcaacacagaaccgaaacuagcuuggguacgcaaugccgacuguaaauaccauuuuuuauuuauggacaguuucucagaaaugcuacaagaguuuaaaacuaacaguccccaauauauuagugaagaaagcaaaguaccauaugacuggacgcuguacuaucuaaggaaaaaagcgcuaacucauaaaguaaccaaagaagaacuagcauggauauuacuuaacuucaaucaaaaacggggauacuuucagcuacgagaugaaucagaagaagagaaaaaaccaagcaaaauuagacaguauuuugaacaccaaaaaguaguggauaucaucgauacgaaugaaguauacaaaggacugaaaguacuuauaguaauucuagcaaauggaauaagcggaaaaauuuuuaagaaggaaauaccagauuggauaggagucgaaaaggauauuauugugaagguggacaucgacaaagauggaaaagauaaauucaacgaagaugguucauuaaguugccgauuuaauauaccaacugaagccgaaugggauacagaaugggaacuaauaaaacagaaaacccaaaaugauuuggacgcaucugguaaaacggucggagaauauauauuugacacacuuuuacguaaucccgagcaaaagauacgagggaagcuaguuagaacaauugaaaggagguacuacaaagaggaaauaaaugccauucucaaaaaacaaaaagaauuucacccggaacuaucagaccgagcucuauaugaaaaaugcguagaagaacucuacccaaacaauccagcacaucguaauaugauguuaauacaugauuuaucauacuuccuagucaacgacauauuauucuaccaaagaccacuaaaaucuaaaaaaucacucauagacgagugcccauacgaaucacaccuauauauagacaaaaaaagcggcgaaagaaaaccaguggcuguuaaaugcauagcuaaaagucacccucuuuaccaagaauuucgacuauggcaauuuaucuccaaucuucgaauuuaucagaaaacaaaagaaguaggcaauagcuugaaaguagacguugacgucaccaacgaauuuuuaaagggagaaaaugacuauguagaauuauuugauugguuaaacacuaaaaaagaaaucaaacaagaagacuuccuaaaauacaagccuuucggguucacuaaaggcaacauuaauaacuacagauggaacuauguagaagacaaaaucuacccuugcaacaaaacacauuauacuauacugaaagguuuagaaaaagcagauauuacauuugacgaguucauuucacaugauucguuagcggaagaaaaucuuuggcauauacucuacagcgucagcucuaaagaagaauuaaagcacgcacuagaaucguucgcagacaagcgaggccuauccauaaaauucguagacgcauucaucaacacaccagcguucgaaaaaucauauggcgcuuauucagccaaagccauuaaaaaacucuuaccgcuaaugcguaugggaaaauauuggaaagaagaaaauauaugcgacucgacgcgagaacgcauagacaaaauaauaacaggagaauacgaugaaaauauuagagaucgaguacgagagaagucaaucaauuuaacggacauaacacuuuuucgagguuuaccacucuggcuagcauguuacgucguguaugaucgacacagugaagcaggaaauacugagagauggacaucacccagugacauagaucacuacauaagaaaauucaaacaacacucccuacgaaauccuauuguagaacaaauuguucuagaaacauuaagaacagucagagauguauggaccgaaguaggcggaauagacgaaauucacguagaauuaggcagagaaaugaaaaacccuuccgacaagcgacgaaaaaugagucugcaaaugcaagaaaaugaaaauacaaacuuacgaaucaaagcauuauuagcagaauucaucaacccagaauuagggauagaaaacguacgaccauauuccccaagccaacaagaccuacuucguuuauacgaagaaggagcauggaacucacccgaaauugaugaaaaacaaguagacgaaauguuagcaauauuaaagaaauuuaacgaaacagacucaaguaaaaggccaacuaaaagugaaauaaaaagauauagguuauggcuagaacaaaaauacaggucaccauacacugggacaccaauaccucuaaguaaacuuuucacgacggccuacgaaauagagcauguaauaccacgaagccgauuuuuugacgacuccuuaacaaauaaaguaauuugcgaaucagaaguaaauaaacuuaaaggcaauaugcuugguuacgaguucauaaaaagccauuacggcgaaaaagugcaacuaucaaguggaagugaagugcaaauauuuucagugaacgacuaugaaaaauucguuaaagaccauuauucaaaaaauaaagcaaaaaugaaaaaacuacucauggaugauauaccagaaaaauuuacagagcggcaaaugaacgacucgcgauacauaaguagacuaauagucucacugcuaaguaauaucguuagagagaaaggagaacaagaaucaaucaguaaaaacguacugguauguacaggcggaguaacagaccgcuuaaaaaaugacuggggaguaaacgauguauggaacaaaauaauacuaccacgguucaaaagaaugaacgaaaucacagacucgaccgacuacacaagugucaacacaaguggacacauuaucccagcaaugccucuacacuuacaaaaaggauuuaacaaaaaaagaaucgaucauagacaucacgcaauggaugcuauuguuauagcaugugccggaagaaacaucguaaacuacuugaacaaccaaaguucaaaaagcgacgucucaagacaugaucuaagaaacuuacuaugcgaaaaagauaaaagcgauagaaaagaacugauaauaaagccaugggacacuuuuacgcaagaugucuacagcgucuuaaguucaauaauaguaucaauaaaacaaaauuuacgcguaauaaacaaaacaaaaaacauauaccaacgaaaagaagacgggaaagugauaauuucuaaacaagaaaacaauauaaacuggugggcaaucagaaaacccuuacacaaggagacgguaucaggggaaguaaacuuaaggaaagaaacuacuaucucccuaaaagaagcaauugacaauccagccagaauaaucgauaaagacuucaaaaaaaaacuacgugaauuaauacuaaugggauauaaugaaaaacuuauaaaaaaauacuucuaugacaacaacgagagcuggcaagacgucaauuuaaaaaaaauuccagcauacuacuuuacaaaagacacaaaugacagauacuuugcaagucgaagcuuauuagacgaaaacuucgauaaaaaaaagauagaaaauaaaguaacagacacaggcauaagaacuauauuauuacgacaccuagaaguagagggaggugacucaaaaguagcguuuucaccagaaggauuagaaagaaugaacaaaaacauagaaauuuuaaacggaggaaagaaacauaaaccaauuuauaaaguacgggaauaugaaaaagcugaaaaauuugcaguaggcaugagagggaauaaagcuucaaaguuuguugaagcugcaaaaggaacaaauuuguucuucgcagucuaugauaacggcaaaaaaagguccuucgcaacgguaccccucaaugaggucaucagauuacaaaaagaagguuuaccauccgccccagcaaaugaagaaggacuacugccaaaauucguucugucaccuaacgauuuaguguaugucccaacggaagaugaacucagaaguggccuuuuacccgaaaacccggcacccgaaagaaucuauaaaaugguaucuuguacgggauaccaaugcuuuuucauacauuucucuguaucuggcguucucugcgauaaaaaggaauucuccuccuuaaacaagauggaacgagcaauuagcggagaaaugauaaaagaaauauguauaccguuaaaggugaacagauuaggaaagauaauguacaauuuguga

SEQ ID NO: 9213 - RNA, 4506 nt, Artificial Sequence
  Cas9 variant
augaagacaauucuuggccuagaucuaggaaccaacucgauaggcugggcaaaaauaucuauagacgauaaugggaauuauuuacgagacauucaacuugguuccagaauuauacccaugucucaggauguacuuggaaaauucgauaauggaguaacugagucacaaacagcaguucgaacaggauucagaggacucagaagaauaagagaacgaucuuuacuaaggagagaacgacuccaucgagucuuacauguuaugggauucuuacccccacauuaugauagugcaauuggcuggaacaaagaagaaccaucaaccuacgguaaguuuuuaaaccacggugaaccaaaacucgcgugggaaagacagggugaugguagcaugcgauuucuuuuuauggacagcuuccauaaaaugauggaagauuuugcaccacaccaaccagcccuagucgcagauggucgaaaaauaccccucgauuggacucuauauuaccuaaggaagaaagcacucacacaaccaaucaagaaagaagaacuagcguggaucuuguuaaauuucaaucagaaaagaggcuacuaucaacuuagaggagaagaagaagaagaaaaccccacaaaaagggaagaauaccacgaauuaaaagugguaucaguagaagcagcugaagaaggaaaggguggaaauacaugguacaacguaaaauuagagaacggcuggaucuaucauaggccgucaaagauagacuuaagcgauuggguagguaagacaaagcaauuuauuguaacaauggaauaugaagcugacggaauaacacucaagaaaaauaaggaaggagaggugaaaagaucuuucagaguacccgacgaggacgauugggguuuacgaaagaagagaacagaaucacaacuagaggcaucaggcaaaacgguaggagcauuuauauacgaucaccuacuagcagaacccgcagauaagaucagaggaaacuuuauuagaacaauagaaagaaaauacuauaaacaagaauuagcagauauacuucgagaacaaucgaaauaucaugaagaacuacaaucaaagaaaaucuuagcagauugugcugaagaguuauauagaucaaaucagccucaccgggauucacuguugaagaaagacaugguuuaucuacuccuaaccgauuugaucuuuuaucaaagaccacucaaaagcaagaaaucacucaucgcuaauugcccauacgaauacuacgaauauguggauaaagaaacaggugaaauuaaaagacaaggcauaaaauguguagcaaaaagcaauccauacuaccaagaauuuagacuguggcaauuuguguugaaucuaagauuguaugauaggacagaagauaaagaagugacagcugaauaucucccaaguaaagaagauuacgcaagacuauucguauauuuaaaugaccgaaaagaaauaaaucaagagacucucuuaaaagauuucuuuaaacuaaagaaaguaaaacagagaagugaaaaagaauuuccaguuagauggaacuacaucgaagauaaagaaaagaaauacccauguaaugagacacgacacgaguugcuaauggcauuagacagagcaggcauggaaagaaguugguuagacgauacagcgaggcaauaucgcuuauggcauuuauuauauucgauagagguaaaagaugaagcggaacgagcccuacgaaaacuaaaagaugaugaugaauuuguuagugcauuuuugaagguaaaaccguuuaagaaagauuauggagcauauagcgaaaaagccguaaagaaacuacuagcagucaugcguaugggaucccauuggugugaagaugacauuuguaaagaaacaaaagaaagaauugaacacauucuacagggagacguagaagagaaaauaaaagaaaggaugaaccauacagcuuauagucuaggggaacuuagcgauuuccaaggauuaccagaguggcuagcaugcuacguaguauacggucgacacucggaagcuacugauauaaaacauuggaaaacgccugagagcuuaauggccuauauuaacggauuuaaacaacauucucuacgaaaccccauagucgaacagugcauucucgaaacucuaaggacaguucaugauauauggaaagaagccggacauauugaugaaauacacguagaauuagguaggucuaugaaaucaaccucugaccaacgggccagaaugacagaaaauauacuaaggaaugaaaauacgaaucucagaauaaaaucauuauugauggaacucaaaaaugacgcugauauaaaagauguaagaccuuacucaccaaugcaacaagaaaucuuacgaauauacgaggaaggagcauugcaagaacucaccaaagaagauaacgacuaugaagaaauuuucaaaaucagcaaaaucccacaaccgucugcuaaggagcugcuuaaauacaaacuuuggcuggaacagaaguaccgcucaccauacacugguaagccuauuucgcuaucaaaauuauucacuucagcauaccaaauagaacauauaauaccacaaucaagauauuucgacgacaguuuuaacaauaaaguaauaugugaaucugaaguaaaugcccuuaaaaguaacaugcuaggcuaugaauuuauuaaaaaucacggaggcgaaaucguacacugcacauuacuuggagaugucaagguacaaaacgagucugaauauaaagccuucguaaccgaacacuacgcaaacaauaaauacaagaaagaaaaauugcucauggaggauauuccacaagacuuuuugaacagacacuuaaaugauucaagauauauaucaaaaguaguuaaaaccuugcuaucaaauauagugagaacagaagacgaaauggaaaccacauccaaauucguagucucauguaccgggggaauuacagaucgauuaaagaaagauuggggacuuaacgauguauggaacucuauagucuauaguagauuugaacgauuaaaugaacugacaaaaagcgaugcauuuggcagaugggaaaauaaagaaggaaaacgcguuuuccaaacaagugucccauuagagcuccaacguggauucaauaagaaaagaauagaucauagacaccaugcaauggaugccuuagucauugcuugugccucccgaaacaucauaaacuacuuaaauaaugaaagugcaaauuccccaaagaaaagagaagaccuacgacaacaauuaugcgauaaaaauagaauuauccgaaaacccugggaaucauucacgcaagaugcgagagcagcccuagaagauguugucguaucuuucaaaaacuauguaagaguaauuaacaaaacaacaaacuauuacgagagauauggagcugauggagagaaaacuauugcaaaacagaaaaacucggaaaugugggcaguaagaaaaccuaugcacgaagcaaaguauuauggcagagucaacuuacaaagaaaaacagaaguacgcuuaaaagcagcauuagaggauaucccuagcaucugcaacaaagagcuccgagacuauauuaauagacucguaaaaucaggauugaaugcuagacaacuguuagcacacuucaaaaguacagauuauuguuggaauaaacaaaauguagauaaagucgagguuuggagauuuagugacgaaaaagaaccccuaguugcuauaagagaaucauuagacacaucuuucgaugcaaaaagaaucgacacaauuaccgauacagguauacagaaaauuuuguuaaacuauuuagaagcuaaaggaggcgacccugcaaucgcuuuuacaccagaaggaauugcugaaaugaaucaaaacauggcauuauacaauaauggaaaaaugcaccagccaauauuaagaguacguuuaucaaagaaacgagguaagaaauaucagguaggacaaacaggaugcaaagcaaaacaauucguuauaucagaaucuggaaccaaccuauacuucgcgauauaugaagacgaagaucgcaacagaacauauaauacuauaccacuaaacgaaguugcagagagacuaaaacaggguuuaucaccaguaccggaaaagaacgaaaaagaaguaccacuuaaauucuaccuaucaccuaaugaucuugucuacguuccaacagaagaggaaauacuuaugaaggaauguaaauugaacaaaaacagaauauauaaauuuauagauucaucuggcacaacugccaauuuuguaccacauagaagugcaucguuaauauacaacgucgauaaaaagcuggcugaagcauuuugcaacgacgaaauaauacaaaacgaauacggcguaggaucaccacaaagcaaaaaccaaaaagcacugacaggagaaaugaucaaagcaguauguuggaaguuagaaguugaccgacuagguaauauaauacgaguaauaaaguga

SEQ ID NO: 9214 - RNA, 4515 nt, Artificial Sequence
  Cas9 variant
augaaaaauauaguuggacuggaucuaggaacaaacagcauaggaugggcaguaguaaauggcaauauaaacgacgaugguagugaacaauuaguaaaaauacaggcuuccgguagcagaaucauaccaauggacgcugccaugauaggagacuucaacaaaggaaauaguauaucacaaacagcagaaagaaccagauugagaggcauacgaagauuaucugaaagguaccuccugagaagagaaaggcuccaccgcauacucgauauccucggcuuucuaccgagccauuucgcaagagaccuagauagauacggaaagauaguaaaggacaaagaacccaaauuagcauggcgcaaaaaugaagcaggucaauucgaauuuauauuucaaaauucauuuaaagaaaugcuagaagauuucaaacuuaaucacccaaaucuuauaacggaugauaagaaaguucccuacgauuggacgauauauuacuuacguaagaaaggucuuaccagcaaaaucucuaaagaagaacuagccuggauuuuauugaacuuuaaccagaaaagaggguauuaccaauuaaggggugaagaagaagaagaaaacaaaaauaaacaaguugaguucuaugcccuaaaaguuaucgccguagaagacucaggcgagaagaaaggaaaagacacaugguacaauguucacuuagaaaacggauggauauaucgaagaacgaguaacaugccucuugacuggguaggaaaaacgaaagaauuuauaguuacaacugauuuagaaaaagauggcacuccaaagaaagauaaagaagguaauauaaaaaggagcuucagagcuccaaaagaagacgauuggagcuuagugaaaaagaaaacggaagcugacauagaucaaacucauaaaacagucggaacauauauauacgacacguuauuagguaacccaagccagaaaauaagaggaagacugguacgaacaaucgaaagaaaauacuauaaagaagaauuaaaauuaaucuuagacaaacaaaaagaguuccauccggaacuucaagauagagcucuuuacgcugcauguguggaagaauuguauacuauaaacgaagcacauagaaauaauauuggaaauagagacuucacauauuuauuuuuggaagacauacuuuucuaccaaagaccccucaagaguaagaaaucacucauagauaacugucccuacgaagaaaaucauuguuuagacaaagaaacgggagaaauaaaauucuuucccgucaaaugcauagccaaaucccauccucuauuucaagaguuccgacuauggcaauuuauagucaaccuacguauauaccgaaaaggacuagcacaggauguagacgugaccaacgaauuacuaaaaacugaagaagacuacguagcacucuucgacugguuaaacgguaagaaagaaauagaccaaaaagcauuuuuaaaauacccaccguuuggauuaaagaaagaaguugaaaacuacagguggaacuauguacaagauaaaucauaucccuguaacgaaacaagaucacuuauguuggcccgauuagaaaaaugugacauaaguaucgaauuucuuacaaaagaaaaugaagaggcuuuauggcacauauuauacucagucgaagauaaaaacgaaauaguuaaagcacuacaaaaauucgcagauaaacacaauuuaaacgccagcuuuguagauguguuccaaaaauuuccaucauucaagaaagaauaugguaguuacucugcaaaagccaucaagaaauuacuaccucuaaugcgaaugggaaaauauuggucugaagauaguauagacaaaggaaccagagaaagaauggauaaaauaauaacaggagaauacgacgaaaagauagaaaaucgagugcgagaaaaagcaauacaccucgcagauauaagcgaguucaaaggguuacccuuaugguuaguauguuauauaguguacggacgucauuccgaaaguaaagaaauagcaaaaugggaaagcccagcagacauagauucauaucuuaaaucauucaaacaacauucacuccgaaacccaauuguagaacaaaucauaaucgaaacacuaagagucguacgagauaucuggaaacaggucggaaacauagaugaaauucauguagaauuagggagagaaaugaaaaauccugcagacaaacgaagaaaaaugacacaacaaauaucagaaaacgaaaauacaaaucuuagaauaaaauaccuucuaacagaguucuuaaaccccgaauaugaaguagagaauguucgaccauauaguccaagucagcaagacauauuacggauauaugaagaaggaguauuaaauucaguauccaaccuaccagaagagauaucagauauacuaaagaaauucacagaaacagaccugaaaaagagaccaucaagauccgaaguacuuagauacaaacuaugguuagaacaaaaauacagguccccguauacuggagaaguaauccccuuaggaaaacuauuuacuccugcauacgaaaucgagcacgugauaccacaaagccgguacuucgacgacucuuuuagcaauaaaguaauaugugaagcagaaguaaauaaauuaaaaaguaaucucuuaggucaugaguucauaguaaagcaccauggggaaaucguugaacuaccauuuggcaagaaagucaaaauuuuuacgguagaugaauaugaacaauucgugaaagauaacuacaguagaacaagaggaaaaaugaagaaacuauuaguagacgauauuccagaagaguuuguugcucgacagcuaaacgauucaagauauauaucaaaaguaguaaaaaguuuguuaagcaacauaguuagggaaaaaggagaggaagaggccauaucuaaaaacgucaucccauguacggguggagucacugacaggcuuaagaaagauuggggagucaaugauguauggaacaaaauaauccuaccgcgauuccaacgacuaaaugaauuaacagguacuaauaaauuuacaacaaugagcuuaaacaaucacgaaauaccagccaugccacuugagcuucaaaagggauuuaauaagaaacgaauagaccauaggcaucacgcaauggaugcuauaauaauagccugugccaauagaaacauaauaaacuaccugaacaaugaaucagcaacugccaaagcagaacucagucgguaugaccuacaaagauuauuaugcgauaaagcaaaaaccgacgacaacgguaacuacaaauggguaauaagaaaaccaugggcaucuuuuacacaagacguacaugguguacuagaggacauaauaguauccuuuaaacagaacuuaagagucauaaacaaagcaacgaaccauuuccuacacuauaacgaagaaggaaagaaaaucuucguaaaacaagagaaaggagacucaugggcaauuaggaaaaguaugcacaaggacacaguauuuggugaaguaaaccuaagaagaaucaaaaccguagcacuaaacgaggcaaugaaaaauccacaaagcauaguuguaaaagacuuuaaaaggaaacuacuagaacucuuaaaucucggauucgacgcaaaacgaauuaagaaauacuuugaggacaaucgagaaacuuggagcgacauaaauuuaucaaaaauaacaguuuauuacuuuucuaaagauacaaaagaccgcuuuuucgcaacaagaaaaccauuagauacaaguuuugacaggaagaaaauagaaaacaacauaacagauacagggauucagaaaauacuuuuacgacaucuugaguuaaaagacaacaacccagacaucgcguucagucccgacgguaucgaugaaaugaaccguaacauaauacaacuaaauaauggaaaauaccaucaaccaaucauaaaaguaagaugguacgagcaagcagauaaauucgcaguuggacaaacgggaaauaagaguagcaaauucguggaagccgcaaaagguacaaauuuauucuuugcuguauaugaaucaaacauacuggacgagaaaaccaacacaauuaucaagaaaagaaacuacgcuacaaucccacuaaacguagcaauagaacgacaaaaacaaggcuuaucggucgcaccugaagaagaaaacggcaaugacccgauauucguccuuucuccaaacgauuuggucuaccucccgacaacagaugagcuugcaaauggcguaguagcacagccacuugauaaagaacgaauauauaaaaugguuaguugcacaggaaaugagggucacuuuaucccagcgcgaauugcaaauccaauccuccaaacaaucgaauugggaucgaauaacaaagcccagaaagcauggacagaugagaugauaaaagagaucugcaugccuauaaaaguggauagacuagguaacaucuuggagucaagcagccugcauaagaaauga

SEQ ID NO: 9215 - RNA, 4515 nt, Artificial Sequence
  Cas9 variant
augaaaaacauagucgguuuagaccucgggacaaauucaauaggaugggccguuguaaacggaucaguuaacgacgauggcucagaacaacuaguaaagauacaagccuccgggagucgaauuauuccgauggacgccgcaaugauuggagacuucaauaaaggaaacucaauaucgcaaacagcagaaaggacaagauuacgagggguuagacgccugucagaacgauaccuacuacgcagggagcgacuccaucgaauauuggauaucuuaggauuuuuaccauuccauuuugcacaagaucuggaucgccauggaaaaauaguaaaaggaaaagaaccaaaacuagccuggagaaaaaacgaagcgggacaauuugaauucauuuuucaagacucauuuaaggaaaugcuagaagauuucaaauuaaacuauccaaauuuaauuacugacgauaagaagguaccauaugauuggaccauauacuacuuacggaaaaaaggacuaaccucaaaaauaucaaaagaagaauuagcauggauucuacuaaacuuuaaccaaaaacgaggauacuaucaauuacgaggagaagaagaagaagagaacaaagacaaauuaguugaauucuaugcacucaaaguaguagcuguagaagauucuggagaaaaaaaaggcaaagacaucugguacaauguccacuuggaaaacgggugggucuauagacguacgucaaacaugucacuggauuggguaggaaaaacuaaagaauuuauuguaacaacagaucuagaaaaagacggaacaccgaaaaaagauaaagaaggaaaugugaagcgaucauuccgagcaccaaaagaagaugacuggucauuaguaaaaaaaaaaacagaagcugacauagaucaaacccacaaaacaguuggcgccuacauauaugacacccuacuagguaauccaucgcaaaaaauucggggaaggcuaguaaggacaauugaaagaaaauauuacaaagaagaauuaaagcuuauucucgaaaagcaaaaagaguuccaucucgaacuucaagaucgcgccuuauaugcagccugcauagaagaauuauacccaauaaacgaagcacaccguaauaauguaggaaaccgagauuuuacauauuuauuucuggaagacauacucuucuaucaacggccauugaaaucaaaaaaaucacuuaucgacaauugccccuaugaagaaaaccaaggacuagauaaagaaacuggagaaaucaaaucauuuccuguaaagugcauugcuaaaagucauccauuauuccaagaguuuagauuauggcaauuuaucauaaaucucagaauauauagaaaagacuuagcacaagaugucgauguaacuaaugaacuuuuaaagacagaagaagauuauguagcgcuauuugacugguuaaaugggaaaaaagaaauagaucagaaagcauuccuuaaguaucccguauuugguuuaaaaaaagaaauagaaaauuaccgauggaauuacgugcaagacaaaccauacccgugcaaugaaacgcgaagcuuaauguuagcacgcuuagaaaaaugugauaucuccaucgaauucuuaacaaaggaaaacgaagaagcacuauggcauauacuauacaguguugaagacaagaacgaaauaguuaaagcacuucaaaaauuugcagauaaacacgaucucaacgcaagcuuuguagacguauuucaaaaauuuccucccuuuaaaaaagaauauggaaguuacucagcaaaagccauuaagaaacuacuaccacuuaugcggauggggaaauauuggucagaaaacagcauagauaaaggaacccgugaaagaauagauaaaauuauaacuggggaauacgaugaaaaaauagaaaauagaguuagagaaaaagcgauacaucucgcagauguaucagacuuuaaaggauuaccacuauggcuaguauguuauauaguauauggaagacauucagaagcuaaagaaauaauacaguggaaaucaccggcagacauagacucauaccuuagaagcuuuaaacaacauagcuuacguaauccaaucgucgagcaaauaaucaucgaaaccuuacguguaguacgagacauauggaaacaaguuggcaauauugaugaaauucauguugagcuagguagagaaaugaaaaaucccgcagacaagagaaaaaaaaugacccaacaaaugucagaaaaugaaaauacaaaccuaaggauaaaauaccuuuuaacggaguuccuaaacccagaauaugagguagagaacguccgacccuacuccccaucacaacaagauauauugagaauuuaugaggagggaguauugaauagcguuagugaucuaccagaagaaauuucagacauuuuaaaaaaauuuaccgaaacagaucucaagaaacgcccuagcaggagcgaaguauuaagauacaaauuauggcucgaacaaaaauacaggucuccauauacaggagaaguaauuccacuaggaaaacuauucacacccgccuacgaaauagaacauguuauaccccaaagcugcuacuuugacgauaguuucuccaacaaaguaaucugugaagcggaaguaaacaaauuaaaguccaaucuacuaggucacgaauuuauaguaaagcaucacggagagauaguagaacuaccguucggcaaaaagguaagaauauucacagucgacgaauaugaacaauuuguuaaagacaacuacuccaggacucgcaguaaaaugaagaagcuacuuauggaugauauacccgaagaguucgucacaagacaauuaaaugauucaagauauauaaguaaaguaguuaaaagcuuauuaucaaacaucguaagggagaaaggggaagaagaggcgauaagcaaaaacguuauaccuugcaccgguggaguaacagauaggcuaaaaaaagacuggggaauaaaugaaguuuggaacaaaaucaucuuaccccgauuccaaagacuaaacgaacuuacaggaaccaauaaguuuacaacuaaaaacguaggaauucaagaaauaccaaccaugccauuagaacuacaaaaaggauucaacaaaaaaagaauagaucacagacaucaugcaauggaugcaauaauuauugcaugugcgaaccgaaauauaauaaacuacuuaaacaaugaaagugcaacagcaaaagcagaacuaucaagauacgaucuacaaaaaaugcuaugcgacaaagcaaagaccgauaauaaugggaacuacaaguggguuauuagaaaacccugggcauccuucacacaagacacauaucuagcccuagaaaacauaauaguuucguuuaaacagaaccuccguguaauaaacaaagcgacaaacagguucuuacacuauaaugaagaaggcaaaaaaauauuuguuaaacaaggaaaaggagauaacugggccauacgcaaaucaaugcacaaagauaccgucuuuggugaagucaacuuacggagaaucaagacaguagcacuaaaugaagcgaugaaaaauccucaaaguauaguuguuaaagauuuuaaacgaaaguuacuagaguuauggaaccuagguuucgacgcaaaacgaauaaaaaaguauuucgaagauaacagagaaaccuggucagauauuaauuuaucuaaaauugaaguuuacuacuuuucgaaagauaccaaagacagauuuuuugcaacacgaaaaccucuagauacuucuuuugaccgaaaaaaaauagaaaacaacauuacagauaccggaauacaaaaaaucuuauuacgccaucuugaauuaaaagauaauaauccagauauagcuuuuucuccagacggaauugacgaaaugaaucgaaauauaauccaguugaauaacgguaaauaucaucaacccauaauaaaaauuaggugguacgaacaagcugauaaauuugcagucggucaaacaggaaauaaaaguucaaaguuugucgaagcagcaaaaggaacaaacuuauucuucgcaguguaugagucaaauauacuagauaaaaaaacaaacacuaucauaaaaaaaagaaacuaugccacuauuccacuaaauguagccauagagagacaaaaacaaggccucccgguagcaccugaagaugaaaacggaaaugauccaauauucguauuaucacccaacgauuugguauaucucccuacagacgaugagcuugcaaacggaauuauagcucaacccuuagauagaggaagaauauauaagaugguaucgagcaguggcgaacaauguuuuuucauaaagcauauagucgccaacguauuaguagacaaauucgaauucagucccuuaaauaaaauggagagagcccuaacuggugagaugauuaagaugauauguauaccaauuaaagucgacaggcugggcaacguacuugaaagcucauccaguuacaaaaaauga

SEQ ID NO: 9216 - RNA, 4515 nt, Artificial Sequence
  Cas9 variant
augaaaaauauuguuggacuugaccuuggcaccaacagcauaggaugggccguuguaaauggaucuguuaacgaugacggauccgaacaauuaguaaaaauucaagcaucagguucucgaauaauaccuauggacgcagcaaugauaggggacuucaauaaagguaacagcauaucacaaaccgccgaaagaacacgacucagaggaguaagacgucuuagcgaaagauaccucuuaaggagagaaagacuacaccggauacuggauauucuaggguuccuuccauuccacuuugcacaagaccucgaccgucacggcaaaauaguuaaaggaaaagaaccaaaauuagcauggaggaagaacgaagcaggacaauucgaguucauauuucaagauucauuuaaagaaauguuagaagauuucaaacuaaaccacccgaaucugauuacagacgacaaaaaaguaccauaugauuggacaauuuauuaccucagaaaaaagggcuuaacaucaaaaaucucaaaagaggaacuagcauggauuuuacuaaacuucaaccaaaaacgagguuauuaucaauuaagaggagaagaagaagaagaaaauaaaaauaaauuagucgaauucuaugcccucaaaguugucgccguagaggacucuggagagaaaaaaggcaaggacauaugguauaauguacaucuugaaaauggcuggguguauaggaggacaagcaacaugccauuagauuggguaggaaaaacaaaagaauuuauugucacuaccgacuuagaaaaagacggaacgccaaagaaagacaaagaaggcaacguaaaacguucauucagagcaccaaaagaagaugauuggaguuuaguaaaaaaaaaaaccgaagccgauauugaucaaacccauaagacagucggagcguauauauacgauacauuguuaggcaauccaagccaaaaaaucagggguagacuagugcguaccauagaaagaaaguacuauaaggaagaacuaaaacaaaucuuagaaaaacaaaaagaauuccaccuagaauuacaagacagagcacuauacgccgcauguauugaagaacucuauccuauaaaugaagcacaucggaacaacgugggaaaucgggacuuuacauaccuauucuuagaggacauucuauuuuaucaaagaccacuaaaaucaaaaaaaucccuaauagauaauugcccauacgaagaaaaccaaggauuagacaaagaaacuggugaaauaaaaagcuuuccuguaaaaugcauagccaaaagccauccacuauuccaagaauuuagauuauggcaauucauuaucaaucuccgcauauacagaaaagaccuggcacaagacguugaugucaccaaugaacuccugaaaaccgaagaggauuacguggcacuauucgauuggcuaaacggaaaaaaagaaauagaucaaaaagccuucuuaaaauacccuguauucagauuaaagaaggaaauagaaaacuacagguggaacuauguacaagacaaaccguauccuugcaaugagacacguagccucaugcuagcccgcuuagaaaagugcgacauuucuaucgaguuuuuaacgaaggaaaacgaagaagcccucuggcacaucuuauacuccguugaggauaaaaacgaaauaguaaaagcacuacaaaaguucgcagauaaacacgaccucaacgcaagcuucguugacguauuucaaaaauuuccgccuuuuaaaaaggaauaugguuccuacucagcaaaagcaauaaaaaaguuacuaccauugaugagaaugggaaaauacuggucagaaaauucaauugauaaaggaacucgagcacgaauagacaaaauaauaacuggagaauacgacgaaaaaauagaaaauagaguaagagaaaaagcgauucaccucgcagauguaucagacuuuaaaggacuuccucuaugguuaguaugcuauauugucuauggacgccacucggaagccaaagagauaauacaauggaaaucuccugcugacauagacucauacuuaagaucauuuaaacaacauucauuacgaaaccccauuguagaacaaaucauuauugagacuuuaagggucguuagagauauauggaaacaaguaggaaauauagaugagauccauguagaguuaggccgagaaaugaaaaaccccgcagacaaaagaaagaaaaugacacaacagaugagugaaaaugaaaauacaaaccuccguaucaaauauuuauuaacugaauuccuuaacccagaauacgaagucgaaaacguccguccauacucuccaucgcaacaagacauacuaagaauauacgaagaaggaguauuaaauucuguaagcgauuuaccagaagaaauaucagacauauugaaaaaguucacugagacugaccucaaaaaacgcccaucacguucagaaauacuccguuacaaacuaugguuagagcaaaaauacagaucccccuacacaggagagguaauuccauuaggcaaacuauuuacuccagcauacgaaauagaacacguuaucccucaguccuguuacuuugacgauucauuuagcaauaaaguuaucugugaagccgagguaaauaaauuaaaaucgaauuuacuaggucaugaauuuauaguaaaacaccauggugaaaucguagaguugccauucggcaaaaaaguaagaauauucaccguagacgaguacgaacaauucguuaaagauaacuauagccgaacaagaucgaaaaugaagaaacuccuaauggacgacauuccugaagaguuugugacccgacaacucaacgauucuagauacaucagcaaaguaguuaaaucucuacuuucaaauauagugcgugaaaaaggugaagaagaagcuaucaguaaaaaugugauaccuuguacaggcggagucacggaccgauuaaaaaaagauuggggaauaaaugaaguuuggaauaaaaucauauuaccuagauuccaacgacugaaugaauuaacaggaacaaacaaguucacuaccaaaaaugugggauugcaagaaauacccaccaugccccuagagcuucaaaaaggcuucaauaaaaaaagaauugaucauaggcaucaugccauggacgcaauaauaaucgcaugugcuaacagaaacauaauaaauuacuuaaauaaugaaucagcaacugcaaaagcugaauuaucaagguacgacuugcaaaagauguuaugugacaaagcaaaaacugacaacaacggcaauuacaagugggucaucaggaaaccaugggcaagcuuuacccaagauacauaucuagcauuagaaaacaucauagugaguuuuaaacaaaaucucagggugauaaauaaagcgacaaaucgauuuuugcauuacaaugaagaaggaaaaaaaauuuuuguuaaacaaggaaagggagauaauugggcaaucaggaaaucgaugcauaaagauacaguguucggagaaguaaaccuaagaagaauaaaaacaguugcucuaaacgaagccaugaaaaacccccaaucuaucguuguaaaagacuuuaaaagaaaacugcuagaguuauggaacuuaggcuucgacgcuaagagaauuaaaaaauacuucgaagauaacagagaaacauggagcgacauaaaccuauccaaaauagaaguauauuauuuuagcaaggacacaaaagauagauuuuuugcuacgcgaaaaccauuagacacaaguuucgaucgaaaaaaaaucgaaaacaacauaacagacacaggaauacaaaaaauccuacucagacaccuagaauuaaaagacaauaaccccgauaucgcauucucaccagaugggauagacgaaaugaauagaaauaucauacaacucaauaacggcaaauaucaucaaccgauaauaaaaguuagaugguaugaacaagcagauaaauucgcgguaggacaaacaggaaacaaauucucgaaauucguagaagcagcaaaaggaacaaaccuuuucuucgcaguuuacgaaagcaacauacuagacaagaaaacuaauacaauaauaaaaaaacgcaauuaugcaacaauaccacuuaacgucgcaauagaaaggcaaaaacaagggcucccgguagccccagaagacgagaacggaaaugauccaauauuuguccucagcccaaacgauuuaguauaccugccuacugaugacgaacuagcaaauggaauaauugcacaaccacuagaccggggacggauauacaaaauggucucaucgaguggcgaacaaugcuucuuuauaaaacauauaguagcgaacguacugguagauaaguucgaguuuucaccccuaaacaaaauggaaagagcauuaacaggugaaaugauuaaaaugauuugcauacccaucaaaguagaccgguuagguaauguccuugaaagcuccaguucucacaaaaaauga

SEQ ID NO: 9217 - RNA, 4515 nt, Artificial Sequence
  Cas9 variant
augaaacggauucuuggauuagauuuaggaacaaacucaauagguugggccuuaauugaaaacgauuuuaauagaaaagaaggaaaaauugaagcacuaggaucaagaauaauaccuaugucccaagauauacuaggaaaauuugauagcggaguaacaguaucccaaacugccgcaagaacgaacuaccgggguauaagacgucuauaucaaagagacaaccugcguagagaaagauuacauagagugcuaaacauauuaggguuucucccaaaacacuaugcagaaucaauagauuucgaagauagauuaggccaauuuaaaccagaaacagaaguaaaauuacccuaucgaaaagauucagacgacaauuaucacuuuauauuccaagaaucauucaaugaaaugguugaagaauuucaguucaaaaaccccucuuuauuuuauaccaaagcaaauggagaacaauccaaaauaccauacgacuggacacuauacuaucuacggaagaaagcccuaucaaagaaaauaucaaaagaagaauuagcauggauucuauugaauuucaaucagaaaagaggauauuaccaauuacgaggagaagaagaagcagauucuaaagacaaauuagaagaauaccaugcacuuaaaguaagcgacguacaagcuaccgaagauacaaacgccaaaggaacuugguauaacguaauucucgaaaauggcuggauauacagaagacaaagcaaagauagccuauuugauuggaaaggaaaaacgagagaauuuauaguaacaacgagcuuagaaaaaggcggagcaguaaaaauagauaaagaaggcaacgaaaaacguaguuucagagccguagauucagaaaaagauuggauugccauaaagaagaaaacagaaaaugaccuagcgaaugccggcacaaccgugggcguuuacauauaugaaacacuacuuagaaauccggaucagaaaauaagaggaaaacuaaucaaaacaauagaaagaaaauauuaccuagaagaauuaaaagccauacuugccaaacaaauccaagaacacgcggaauuacaaaacaggagcuuauacaaagacuguauagaagaauuauaccaaggaaacgaagcacacaaaaacaacauuaaagaaaauggcuucgacuaccucuuccuagaagacauuauauuuuaccaacguccccugaaaagcaagaaaucgaccauaaguaacugucccuaugaaagcaggguuuucauaaaagacggaaagaaagaaauacagccaauuaaaugcauaaguaaaaguaauccaauauaccaagaauuuagacucuggcaauucauucauaaucugaaaauauaugaaaaagaagcuauagaugauggaaaaacugugauaaacaaagauguaaccacggaguucuuaaauacccaagaagccuaugcagcucuuuucgaauuucucaacgauaaagcugaaauaucacagaacgcacucuuaaaauauuucaaacuuucaacaaauacacacagauggaacaauguugaagauaagaaauauccaugcaacgaaacaagaucagaguucauaaaaagacuaagcaaaauggauggcauagaccugggcaaaacccucuccccagcuuucgagaaaagucuuuggcauauuauauauuccguuaaagacaagaaacaauauguaagagcacuagaaacauuugccaugaaaaacggauuagacaucaaccaauuuagagaaaauuuugaaaaauucaaaccguacgauuccgcauauggagcuuacucagaaaaagcucuaaagaaaguauugccgcuaaucagacgcgguacauacuggaagaaagaugccaucccagccgcaguccaagaaagaaucguaaauauaaugaaacgaauagaaagcguagauuuuaaucucgagaaaaucgaaaacuuugccgacgacgacauacccaaacaacuacuuaaaucuuuugcaaaaggcaaagaucccaugcaaggccucaauacguaccaagcaugcuacgccguuuauaaucggcauagcgaaguuucagacauacaacuuuggaaaucaccagaagacauaaccaaauacuuagauucauucaaacagcauucccuaagaaacccaauuguagaacaaguaguaauggaaaccuuacgaguaguacgugacauauggcaguacuauggaaacggagcuaaagacuucuuuagugaaauacauguagaauuaggacgugaaaugaaaaacgacaagaaaacaagagaaaggaucuccaaauccauaacagaaaaugaaaacacuaacgaaagaauuaaaaauauacuaaaagaauuaaugggagaugaagcccuacaaggagauauaagacccuauaguaaaggacaccaagauauauuaaaacuuuacgaagaaggcguguucgcaaacgcuccugaaacguacaaaaacauaaaaauagaugauaucgagaaaauucguaaaaacaacuccccaucaaaauccgauauuguaaaauauaaacuuugguuggaacagggcuacauauccccguacaccgguagcccuauaccccuaucacgacuauucacaacagauuaucagauagaacauauuauuccccgaucacgguauuuugaugauagcaugggcaauaaaaucauaugcgaaucagcugugaaugaagaaaagacaaauaaaaccgccuaugaguucauuaaagaaaaugcaggacgaauaauagacuuaggucaagggaaacaaguccccuuguucgaucucgaagcauaugaaucacauugcagagguuauuuuaagggaaacaccaagaaauuaaaauuucuccuaucggaagacauaccugaaggauuuauaaaucggcaauuaaaugauucucgauacaucagcaaaguaguaacaucauugcucucaaauguagugagagaagaaggagaacaagaagcuacaaguaaaaaccucguaccucucguuggaacaauaacaucaaaacuaaagaaagacuggggacucgaagcaauaugggacgacuuaauagccccucgauuugaacguaugaaucaacuaacaaaaagcacagauuucaggaaggagguaauugauggacaugguaaucgauacuuuauaaauacaguacccgaugauaucaagaaagguuuuaguaagaaaagaauagaccaucggcaucacgcccuagacgcccuaguaauagccuguacaaccaaagaucaugucaauuauauuacgucacuaaacacacaacgaaauaacagaucucuaguaagcaaauuaagaaagauagaagagaaaaccauaaaagauaagagaacaggucaaccaaaaacaauaaaaauagcgaaagcguaccauaagccuuggccaaauuuuacgaaagaaacauucgagaaacuaagcaaaacaguagucagcuuuaaacaaaaccaacguaucauuaacaaaacuaacaacaagacauggggaugggaaaaaguagacggcguaaugaaaaagguguuaaagaaacaagagaaaagaaacugggcaauaagaaaaccaauccauaaagagaccuacuacgggaaaguaaaaggauucgauucgccaaaagguaaaauaacgacagccacucgcaaaagccuacgggaaauaacuaaugaacgacaacuaaacaccauuacagacaguggcaucaagaaaauucuaaauaaccacuuaaaaacauucaucgaugaaucagguaaaauaaacuucgagccagcauuuaaccaagauggaauagaucugcuaaauaaaaacauccaacaauuaaacgaaggcaaaaaucaccaaccaaucuauaaagugagaauguauacacacaacacaauguuuaguguuggagacgaaggaaauaaaucuacaaaauacguuaucccagaaagcggaaccaacuuauucuuuaauguauacugggacgaagaaaauaacaaaagaaauuucgagacuguaccacuuaaccgugucauagcauuccaaaaacaaacaagucacaucccaagaaaagacagaaccgauguaccuauagacaacacacuuggaagguuucuauuuacacuaucuccagaugaccuaguguaccuaccaacagaugaagaaucugaaaguuuuacuacauucgaaauugauagucuuaauucaaagcaaguagcaaauaucuauaaauucguggacgguucugguacaacaggcaacuucguuccagcggaggcagcgcgaguaauagccaacaucaaagauaagaaaguaagaucaaauuuuuguaaaaggaacaaccuaucagacaagcagcuuaucaaaaacgaguucggacuagguaguccccaacugaaaaaucaaaacucauuagacggucgacaaaucaaaucaauaugcuggaaacuagaaauaaaccgauuaggaaaaaucaucaaagucauuaaauga

SEQ ID NO: 9218 - RNA, 4515 nt, Artificial Sequence
  Cas9 variant
augaagaaaguacuagguuuggacaucggaacuaauagcguaggaugggcaguaguaaaccaaaaugauaaaggugaguuccucucgauagagaaaauaggaucucgcauuauaccaaugucucaggacguaauggacaaauuuggagcggggcaaaccgaaaguaguacagcucagagaacucaauauagaggaguaagaagacucagagaaagaagccuccuaagacgagaaagacuacaccggguauuacacauauuacacuuucuaccgcaacacuaugaugcagcaauagguuggaacaagaaagaaaauaaaacuuaugguaaauuuuuaccuggaguagaagugaauauccccugggucgcaacagaucaaggucaccaauuuauuuucauggacucuuaugccgaaaugcuuaaagacuugaaacaacaucaaccucaucuguucgaaaaaucuaguaccccgguaccucuagacuggacuauuuauuacuuaagaaagaaagcacuaacacaagcuaucucaaaagaagaauuagcauggauacuacuaaauuucaaucaaaaacgggguuacuaccaauuacgaggugaagaaguugaagauaacacaaaaagagaagaguucuaugcacucaaagugguaaaaguggaacuagauaaagacaacacuagcgcaaaaacaugguacaaaguucaucucgaaaacggcuuuaucuauccaugcccuucagacacaccaaucgacaguuggguagguaugguaaaagacuucauagugacaacaacauuggaaaaagauggaagcgaaaaacguacggccgacggagaaauaaaaaggagcuuccgagcacccaaagaagacgauuggacgcuuuuaaagaagaaaacagaaucugaacuugaaaaaucagggaaacaaguuggggcauuuauauaugacacacuucuaucaaacccagaucagaaaauaauaggcggacuaauaaaaaccauagaacgaaaauauuauaagaaagaauuagaacaaauacucgaaacccaacaaaaauuuauagcagaauuaagugacaagaaacucuuucaggcuugugccgaagaauuguauccacuaaaugacucacacagggaaaaccuauuagaaagagacuuuaaacauuuauucguacaagacauaauuuucuaccaucgaccguuaaaaacaaagaaaucacuaaucagcaauugcacauacgaauaccguaccuuuuacaaaaacggggaaaaacaaauaaguccaaucaaauguauagcuaaaucuaacccauuauuucaagaguuccgaguauggcaauucguacaaaaccuaagaauacuacaaagacaaagaucagaaggcgacucaauuaaauacaacgucgacguaaccgcagaauuucucaaagacgaaaacgauauagcaaaucuauucacguggcucaaugaacgaaaaguaaucaaacaagaucaauuacucaaaucauauuuuaaauuaaaagugaacaaagaaacuaaagaauuggacuaccguuggaauuacguugaugacaaaaauaaagaauauccaugcaacgcaacacgaacacacauucugaguuuccucgaaaaaugcaaagaagaaaaacgaauagaagaugauagauucguguacaguuuauggcaucuauuauacucagucguagaaccaaucgaauuaaggggagccuuagcaaaguucgcugaacgagaacaucuucaccccagcuucguagauguuuucgcacaauuuccgccuuuagaaaaggaauauggaucauacucagaaaaagcuauaaaaagacuacuaccauugaugagaaugggagacuacuggcacgaagauaaaauagacguaaagacuaaacaacgaauacaacgcauuauagacggcgaagcagaugacgauauaacacaucgaucacgagaaaaggucgaaaaccuccgaucuauaacagacuucaaaggucugccacuuuggaaggcaggauaugugguauacaaccgucauagcgaauccggcgaacucacaaaauggaagacuccacaugaacuaaguaauuauauucaaaacgaguucaaacaauauucccuaagaaauccgauaguugaacaaauaguacuagaaacacuccguguagugcacgaccuuuggguuaaacauggcgauuucucagaaauccaucuagaauuaggccgcgacaucaaaaauagcucugacaaacgcaaaagaauggccgaaagacaacaagaaaacgaaaacucaagacaacgaguucuagagaugcucauagaucucaagaaagaagcagcauuugcugaccuaaauccauacaguccaagucaacaagaaaaauuacgaauaguagaagaugggguauuaagaaguaacauagaaaucccaaaagacauagagaaaauaacaaaaucggcaaaaccgacgagcagagaauuaaccaaguaucgacucuggcuugaccaaaaauacagaucacccuauacgggucaaccgauaagccucgcacaacuauucacaucaaaauacgaaauagaacauguuauuccgcaagccaaauauuucgaugauucauucacgaacaaagugauaugugaaucagaaguaaacaaagaaaaaggaucgaugcuagcgcacgaguuuaucuuaaagaauggaggaucgacgguuaacgucggaggucgacaaguucaaguccucaaaaaugacgcuuauguugaacuaaucaauagacuauacggcaaaaacaaccccguuaaagcaaagaaauuguuagcagaagacauagacgaaguaguaggagauuucucagaaagacaauuaaaugauacacgauacauaucacgcguaguucaaaaacuguuauccaauauagucagagaagaagacgaacaagaaucuacaagcaaacauguuauuggauguucaggacaagugacaaccgcgcuuaagaaagauuggggguuaaacgacauuuggaacaaaauaauccaacccagauuugaaagacuuaaugaaaugacagccaccgaggacuacggaguauggcaaucaccaaaccacuuucaaauaaggguaccagaagaaauucaaaaaggauuuacuaagaaacgaauagaccauagacaccaugcaauggacgcauuggugauugcgugugccacgcgaucgcacaucaacuauaucaguaauagaucaggacaagaccgaaaugcuaaauuugaaacaacgagaacagauuuaagaucaaaacuguguuauaaagagaacaguagcggaaacaauuauaacuauauauuuaauaaaccaugggauacauucacgcaggaugcacacagggcucuugaaaauaucgucguaucccauaaacaaaaccucagagugcuuacgaaaacgaauaauuacacacaauuuaucaauaaagaugggaagaaagaccuccaaaaacaaguaaaaggcgaccauuuugcaguacgaaaaccuaugcaucaagaaacuauauauggcagaguuucaaucagaucuauaaaagaaguugcuuugaagaaagccuuggaaaauuggaaacaaauagucgauagaacucugaaagacaaaauacgagaacuaauaggcgccuauggaaaauaugacgcccaaacaauccucaaauacuucaaagacagggacuacaaauuuaacaaucuaaaaauaaaucgaguagaagucuaugaauacgaucauaauugcgcagcaguaagaaaaucaaucggagaugacuuaacuauaaaacaaauagagagaauaacugacgaaagcauaagaaaaauacuuaugaaucacuuauccaauuaugacgauaaucuaaaggaagcauucaguccagaaggccucauggaaaugaauaaaaauauaaaagaacugaacggagggaaaaaucaccaaccaauuuacaaaguuagauuauuugaagacuuaggaucaaaauuuccccugggaguaucucauaacaacccugauaaguacgcaaucgccgcaaaaggaacgaaccuauuuuucggaaucuaugaagaucaagaaggaaaaagaauguuugacuccauaccucuaaacauuguuauugauaggcuuaaagaaaagaaaucaccagugccggaaacuuauaacgaaaguaaauuaaaauuucaucuuagcccgaacgaccuuguauauguuccaaccgaugaggaacaaaaacaaccagaauuaguagauguagaccaccuaucagaugagcaaaaaggacggguauauaaagcaguuucauuuacgggaaaucgagccuucuuuguaaaucaucgaguuuccaaagucauacaugauuauguugaguuuggcacgaaaaauaaaauagaaaacgaugaugauaaaagauccuuaaaacacauaugcuggaaacuaaaaguaaaucgauuaggcgaaauaacagacguaaaacgauga

SEQ ID NO: 9219 - RNA, 4515 nt, Artificial Sequence
  Cas9 variant
augaaaaacauuguuggacucgaucuuggaacuaacagcauagguugggcaguaguaaacgggagcgucaacgaugaugggagcgaacaguuaguaaaaauacaagcuagcggaucaagaauaauacccauggaugcugcaaugauaggagacuuuaauaaaggaaacucaauaucccaaacagcagaacgaacccgacuccgaggagucagacgacuaagcgaacgauaccuacucagaagagagagacuacaucgaauacuagacaucuugggauuucuaccauuccauuuugcacaagaucuugaccgucaugggaaaauaguaaaaggaaaagaaccaaaauuagcauggaggaaaaacgaagcaggacaauuugaauuuauauuucaagauucauucaaagaaaugcucgaagauuuuaaacuuaacuacccuaaucuaauuacagacgacaagaaagucccuuaugacuggacaauauauuaucuaagaaagaaaggauuaaccaguaaaaucaguaaagaagaauuggccuggauucuacuaaacuucaaucagaaaagaggguacuaccaacuucguggagaagaagaagaagaaaacaaagacaaauuaguugaauuuuacgcacuaaaagucguagccguagaagauucaggugagaagaaaggcaaagacauaugguauaacguacacuuagaaaaugguugggucuaucgaagaacaaguaauaugagcuuagauuggguuggaaaaaccaaagaguucauaguaaccaccgaccuagaaaaagacggcacaccgaagaaagacaaagaaggaaacgucaaaagaucauuuagagcucccaaagaagacgacuggucacuugucaaaaagaaaacggaagcugauauagaccaaacacacaaaaccguaggagcauauauauaugauacacuauuggggaacccuagucagaaaauaagagggagauuaguacggacuauagaaaggaaauacuauaaagaagaauuaaaacuaauauuggaaaaacaaaaagaguuccauuuagaacuucaagacagggcacuuuaugcagcuuguaucgaagaacuauauccaaucaacgaagcacaucgaaacaacgucggaaauagagacuucacauaccuuuuucucgaagacauacucuucuaucaaagaccacuaaaaagcaagaaaucauuaauagauaauuguccauaugaagaaaaucaaggacuagauaaagaaacaggagaaauaaaaucuuucccagugaaaugcauagcaaaaagccauccuuuauuucaagaguucagacucuggcaauuuauaauaaaccuaaggaucuauagaaaagaucucgcacaagacguagacgucacaaaugaacuuuuaaaaacagaagaagauuaugucgcauuauucgauuggcuaaacggcaagaaagaaauagaucaaaaagcguuccuaaaauauccgguguucggucuaaagaaagaaauagaaaauuaucguuggaauuauguucaagauaaaccauauccauguaacgaaacacgcucucuaauguuagcuagauuagagaaaugcgauaucucaauugaauuucuaacaaaagaaaacgaagaagcccuauggcacauccuauacucaguggaagacaaaaacgaaauaguuaaagcgcuacaaaaauuugcagacaaacaugaccuuaaugcuucuuuuguagacguuuuucaaaaauuuccucccuucaagaaagaauacggaaguuauagcgcgaaagcaaucaagaaacuguugccauuaaugcgaaugggaaaauacuggucagaaaacucaaucgauaaagguacacgagaacgaaucgauaaaaucauaacaggugaauacgacgagaaaauagaaaaucgaguaagagaaaaagcaauacauuuagcagauguauccgauuuuaaaggacuuccauuauggcugguuuguuacauaguguauggcagacauagugaagccaaagaaauaauacaauggaaaucucccgcagacauugauucguaucuuaggagcuucaaacaacacucacuaagaaauccaauugucgaacaaauaauaauagaaacccuacgaguuguaagggacauauggaaacagguaggaaacauagaugaaauccauguagagcuuggacgcgaaaugaaaaauccagcagacaaaaggaagaaaaugacgcaacaaaugucagagaaugagaacacaaaccuacguauuaaguaucuuuuaacagaguuccuaaauccagaauacgaaguagaaaacgucagaccuuacucuccaucacaacaggauauucucagaauauaugaagaaggaguacuaaacuccguaucagaccuaccagaagagaucagugacauacuaaagaaauuuacagaaacggaucucaagaaacgaccuucacgcucagaaguccuuagauacaaauuauggcucgaacaaaaauaucgauccccauauacaggggaaguaauacccuuaggaaaacucuuuaccccagcuuaugaaauagaacacguuauuccgcaaaguuauuacuucgaugacagcuuuucaaacaaaguaauaugcgaagcagaaguaaacaaacuaaaaaguaaucuauuaggacacgaguucauaguaaaacaccauggcgaaauuguagaacuaccauucggcaagaaagucagaauauuuacaguggacgaauaugaacaauuuguaaaggacaacuauucaagaacacgaaguaaaaugaagaaacuccuuauggaugacauuccagaagaguucgucacaagacaauuaaaugacagcagauauauaucuaaaguugucaagagccuguuaucaaauauuguacgcgaaaaaggugaagaggaagcaauaagcaaaaacguaauaccgugcacgggcggaguaacagaccgacuuaaaaaggauugggggauaaaugaagucuggaacaaaauuaucuuacccagauuccaacgcuuaaaugaacuaacuggaacuaacaaauucacaaccaaaaacguaggcauccaagaaaucccaacuaugccacuagaacuacaaaaagguuuuaacaagaaacguauugaccacaggcaccaugcgauggacgcaaucauuauagcaugcgcaaaucgaaacauaauaaacuacuuaaacaauaaaucagcuacagcuaaagccgagcugagccgguacgacuugcagaaaauguugugugauaaagcaaaaacagauaacaacgguaacuauaaauggguaauaagaaaaccaugggccagcuucacucaggacacauauuuagcauuagaaaacauaauagucaguuuuaaacaaaaccucagagugauaaauaaagcgacgaaucgcuuucuucauuacaaugaagaaggcaagaaaauuuuuguaaagcaagguaagggagacaacugggcgauacgcaaaucuaugcauaaagauacuguauucggagaaguaaacuuacgaagaauaaaaaccguugcacuuaaugaagcgaugaaaaacccacaauccauagucguuaaagauuucaaacgaaagcuacuagaauuauggaacuuaggauuugacgcuaaaagaauaaagaaauacuuugaagacaauagagagacauggucugauauaaaccuuucaaaaauugaaguguauuacuucucaaaagacacaaaagaucgcuuuuucgcaaccagaaaaccauuagacacaaguuucgaucgaaagaaaaucgaaaauaauauuacagauacgggcauacagaaaauacuauuaagacaccuugaacucaaagauaauaauccagauauagccuuuucacccgacggaauagaugaaaugaacaggaacauaauacaacuaaacaauggcaaauaccaucaaccaauuauaaaaauuagaugguaugaacaagcagacaaauucgcgguaggccaaacaggaaauaaaaguagcaaauuuguagaagcagcuaaaggaacaaaccuauucuuugcaguauacgaaaguaauauucuagauaagaaaacaaauacaauaaucaagaaaagaaauuacgcgacaauaccacuaaacguagccaucgaaagacaaaaacaaggacuuccaguagcaccagaagacgaaaauggaaaugaccccaucuucguacuaucgccaaaugauuuaguauaucucccgaccgacgacgaacuagcaaacgggaucaucgcacaaccacuggauagaggacggauauauaaaaugguaaguaguagcggugaacaaugcuuuuucauuaagcauauaguggcaaauguccuaguagacaaauucgaguuuagcccauuaaauaaaauggaacgagcacuuacuggugagaugaucaaaaugauauguauaccuauaaaggucgacagauuaggaaacguucuagaaucuagcucaucauacaagaaauga

SEQ ID NO: 9220 - RNA, 4515 nt, Artificial Sequence
  Cas9 variant
augaaaaauauaguaggacucgacuuagguacuaacagcauaggaugggcuguagugaauggcucugugaaugaugacgguagcgaacaacuugugaaaauccaagcaucaggcaguagaauaauaccaauggacgcagcaaugauaggagauuuuaauaaaggaaacaguauuucacaaacugcagaacgaacgcgacucagaggcguaagacgcuuaucagaacgauauuuauuaaggcgagaaagacuacacaggauauuagacauauuaggauuccuaccuuuccacuucgcccaagaucuagacagacacggcaaaauaguaaaaggcaaagaaccgaaguuggcuuggagaaaaaaugaagcaggacaauuugaauuuauauuucaagacagcuuuaaagaaauguuagaagacuuuaaacucaaccauccgaaucuaauuacagacgacaaaaagguuccauacgacuggacaauauauuaccucagaaaaaaagguuuaacgaguaaaauuucaaaagaagaauuagcauggauacuacucaacuucaaucagaaaagaggguauuaucaauuaagaggcgaagaagaagaagaaaauaaaaacaaauuaguagaauucuacgcauuaaaaguaguggcaguggaagauagcggugaaaaaaaaggcaaagauauaugguauaauguacaccuagaaaacggauggguauaccgaagaacaagcaacaugccacuagacugggugggaaaaaccaaagaauucauagugacgacagaucuugaaaaagaugguacaccaaaaaaagauaaagaggguaacgucaaaagaucauuccgagcaccaaaagaagaugacuggucacuacucaaaaaaaaaacagaagcagacauugaucaaacacauaaaacuguaggaguauacauauaugacacacuacuaggaaacccaucucaaaaaauacgcggaaggcuagucagaaccauagaaagaaaauacuacaaagaagaacugaaacaaauuuuagagaaacaaaaagaguuccaccuagaacuucaagacagagcgcuuuaugcagcuuguauugaagaauuauauccaaucaacgaagcucacagaaacaacgucggaaauagagauuucaccuaucuauucuuagaagacauacuauucuaucagcgaccccuaaaaaguaaaaaaucacuaauagauaauugcccauaugaagaaaaccaaggauuggacaaagaaacaggagaaauaaaaucauucccagucaaaugcaucgcuaaaagucauccacuauuucaagaauuuagacucuggcaauuuauagugaaccuacgaauauaucggaaagaccuugcucaagacguugacgucacgaaugagcuacuaaaaaccgaagaagauuacguugcacuauuugacuggcucaaugggaaaaaagaaauugaucaaaaagcauuccuaaaauacccgguuuuuggacuaaaaaaagaaauagaaaacuaccgauggaacuauguacaagauaaaccguacccgugcaaugaaacacggucauuaaugcuggccagauuagagaaaugcgacauaagcauagaauuucucacaaaagaaaaugaagaagcuuuauggcacauccuauacucuguggaagacaaaaaugaaauagucaaagcauuacaaaaauucgccgauaaacaugacuuaaaugcuaguuucguagaugucuuccaaaaauucccacccuuuaagaaagaauacggaucauauuccgcaaaagcaaucaaaaaacuuuuaccuuuaaugcggaugggaaaauauuggagcgaaaacuccauagauaaagguacacgggaaagaaucgacaaaauuauaacaggagaguacgacgaaaagauagaaaaucguguacgagaaaaagcaauacacuuagcagacgucucagacuuuaagggauuaccacugugguuaguuugcuauaucguauacggaaggcauagugaggcaaaagaaauuacacaauggaaaucaccagcggacauugacucauaucugcggucauucaaacaacacagucucagaaauccgauugucgaacagauaauaauugaaacucuccgaguaguacgagacaucuggaaacaaguagguaauaucgacgaaauccacgucgagcuggggcgugaaaugaaaaaccccgcugauaagcgaaaaaaaaugacacagcagaugagugagaacgaaaauacaaaucuccgaauaaaauaccuucuaacagaguuccuaaauccugaauaugaggucgaaaacguacgaccguauucaccaagccaacaagauauccuaagaauuuaugaagagggaguccuaaacagcguuuccgaucuaccagaggaaaucucagauauacuaaaaaaguuuacagaaacagaccuaaaaaaaagacccucuagauccgagauucuaagauacaaauuaugguuggaacagaaauaccggucgccuuacacaggugaaguuauaccauuaggaaaacuauucacuccagcauacgaaauagaacaugucauaccccaauccugcuauuuugacgacucauuuaguaacaaaguaauaugugaggccgaagucaacaaacuaaaaaguaaccuccuaggacaugaauucauuguuaaacaccauggagaaauugucgaauuaccauucggcaaaaaggucagaaucuuuacaguagacgaauacgaacaauucguaaaagacaauuacagcagaaccagaagcaagaugaaaaaacuucuuauggaugacauuccggaggaauuuguuacaaggcaauuaaaugacucgagauauaucucaaaaguaguaaagucccuauuaagcaacauaguaagagaaaaaggagaagaagaagccauaagcaagaacguuauacccuguacagguggaguaacugaccgacugaagaaagacuggggaauuaaugaaguauggaacaaaauaauucucccucgguuccaacgacuaaacgaacuaacagguacaaauaaauuuacaacaaaaaaugucggaauacaagaaaucccaaccaugccauuagaacuacagaagggauucaacaaaaaacgaauagaucaucgucaccaugcaauggaugcaauuauaauagcaugcgcaaaccgaaauauaauaaacuacuuaaacaacgagucugcaacagcaaaagcggaauuaucaagauacgauuuacaaaagaugcuaugugacaaagccaaaacggauaacaaugguaauuacaaauggguaauccgcaaaccaugggcuucguucacccaagauacauaucuagcauuggagaacauaauaguaucauucaagcaaaacuuacgcguaauaaauaaagcaacaaacagauuucugcacuacaacgaggaaggaaagaaaauauucguaaaacaaggaaaaggagauaauugggccauaagaaaaaguaugcacaaagacacaguuuucggagaaguaaaccugagacgaauuaagacagucgcacuaaacgaagccaugaaaaauccacaaucuauuguaguuaaagacuuuaaacgaaaauuacuugaacuauggaauuuaggguucgacgccaaacgaaucaaaaaauauuucgaagacaaucgcgaaacuuggucugauaucaaucuuaguaaaaucgaaguuuacuauuucaguaaagacacaaaagauagauuuuuugccaccagaaagccguuagacaccucauuugauagaaaaaaaauagaaaacaacauaacggacaccgguauucaaaagauacuucuaagacaucuagaauugaaagacaacaauccagauauagcauucucuccagauggaauagacgaaaugaauagaaacauuauacaacuaaauaauggaaaguaccaccaacccauaauaaagauacgaugguacgaacaagcagauaaauuugccgucggucaaacuggaaauaaauuuucgaaauuuguagaagcagcaaaggguaccaauuuauuuuuugcagucuaugaaagcaacauauuggauaaaaaaacgaacacuauuauaaaaaaaagaaauuacgcaacaauaccacucaaugucgccaucgaaaggcaaaaacaaggacuucccguugccccagaagaugaaaauggaaaugaccccauauuuguacuaucaccaaacgaccuugucuaucuacccacagaugacgagcuagcaaaugguauaauagcacagccacucgacaggggacgaauauauaaaaugguauccuguacagguaaugaaggacauuuuauaccagcgcgaaucgcaaacccaauucugcaaacaauagaacuggguagcaauaauaaagcacagaaagcauggaccgaugaaaugauuaaagaaauaugcaugccgaucaaagucgacagacuugggaauguacuagaaucaucaucaagcuauaaaaaauga

SEQ ID NO: 9221 - RNA, 4521 nt, Artificial Sequence
  Cas9 variant
augaagaccauauuaggcuuagacuuagguccaaacaguauagguugggccaaaguagaaguagacgaugaggguaacuaucuuagaaacauaaaauuaggaucgaggauaauucccaugacucaagacaugcucggcgauuucgacaaaggagucaaaguaagccaaacagccauacgaacagacuuccgcggaaauagaagacuuauugagcgucacuuauuaagaagagagagauugcacagaguauuacacgcacucaaguuccucccuaaacauuaugaagacgcgauugguugggaccgcaaugaaccagccacuuauggaaaauucgugaauaacucugaaccuaaacucgcuugggaaagacaagaagaugguaguaugagauuuuuguucauggaaaguuuuaacgaaaugguagcagauuucgcucagaaucaaccuagccuuguauccgacgggaaaaaaaucccucuugacuggacaaucuauuaccuaagaaaaaaggcccuuacgagacccauuaaaaaggaagagcuagcuuggaucuuacucaauuucaaucaaaaaagaggcuacuaccaauuaagaggagaagaagaggaggacaaucucacaaaaagaaaagaauauuauaaauuaaaaguagucggaguagaagcagauggcgcuccaaaaggaggaaagaccugguacaauauccauuuggaaaauggauggacugcucgcugucaaucaaagauuccacucgacgacuggguaggaaaaguaaaagaauauauaguaacaacagaauaugaggaugacggcaaaacuccaaaaugcgacaaagaagguaaagugaaacgaagcuuuaaaaguccagaaaaagacgacuggcaauuaauuaaaacaaggacggaaaaauucauagaugacucaaacaaaacaguaggcgcauuuaucuacgauuacuuauuagaaaaaccauucgauaaaauaagagguaaauauauaagaacgauagaacgcaaauauuauaagaaugaacuucgcgaaaucuugagagaacaaacgaaauaucacgaaggacuacauucucuagaagcauuaaaaaucugugcagaagaguuauauaaaaacaaccaacaacaccaagaguaucuguuaaaaaaagauaugacguuuuuauuacuaaaugaucucaucuuuuaccaaagaccacuaaaauccaaaaaauccuugauagcugacuguccauaugaaguauacaaauacgacgauaaacucaccggaaaaaaaggccaaaaaaaaauaaaguguauagccaaauccaacccuuacuaccaagaauucagauuauggcaauucauagcuaaucucagauuauuuucaguaacagaugguaaggaaguaacugcagaauaccucaaaacagaagaggauuacguuagauuauuuucauucuuaaacgacagaaaagauauaaaacaagaaacuuuucuacgaaguuuucugaaacugaaaaaagaaaguauuggcucagaaaaaauauauccaauaagauggaacuauauagaagaugcaaauaaaucguacccgugcaacgcaaccagacacgaacuccuacuagcauuugaccgcgcugacauaccaagagaauuauuagacguagaagaaagagaauauagauuguggcacuuacucuacaguauagaagccaaagaagaaacugaaagugcucuaagaaagcucaaagcaaacaaagccuucggcgaccucaauauugaugaugcuuucguaaauagcuuuuugaaaauaaaacccuuugaaaaagaauauggugcauauucagaaaaagcaauuaaaaaacuauuagcuguaaugaggagaggaucccuauggaaagaagccgacauaugcgaagcgacuaaacaaaauauagccaaaauacuccaaaaugauauagaugaaaaacugaagaaaaaaauagaagcugcugucucaaguuuuaacaaacucucugacuuccaaggcuuacccacauggcucgcaugcuauguaguauauggucgacacucugaagcagcccaaauacaguguuggcaaaguccagaagaucuaaaaacauacauaaacaaauucaaacaacacucauuaagaaacccaaucguugaacaaugucuauuagaaaccuuacgcacaguauacgauauuuggaaagacgcuggacagauagacgaaauacacauugaauuagguagaaacaugaaaucaacagcagagcaaagagcgcgaaaaacuaaagauauuuuacgaaacgagaacacgaaucuuagaauaaaaaaucuacuaguagaacuaaaaaacgacgauaagauugaaaacguucgaccauauucaccaucacaacaagaaauauuacggauauacgaagaaggagcuuuacaggaacugagcaaagaagaugagauguucgaagauauaaguaaaauuucaaaaauggcucaaccuuccccgaccgaacuaucaagauacaaauugugguuagaacaaaaguacagaucacccuacacaggaagagucauuccucuaaguaaacuauucacuaccgcguaccaaauagagcacauaauaccacaaaguagguacuucgaugauucuuucaacaacaagguaauuugcgaaagugaaguuaacucucuaaaagauaauaugcuggguuacgaauucaucaaagaaugcgguggaagaaucguacacuguacacuacuaggcgacguuaaaauauuuacaaaagaagaauacaaagacuuugugacgaaacauuauauagacaauacuuauaaacgagacaaacuccuacuagaagauaucccgcaagaauuuuccgcgagacaacucaaugacucaagauacauaucaaaaaugguccagacagugcuuagcaacauuguacgagccgaaaaugaacaagaagccaccaguaaauucgugguaucuugcaacggagcaauaacuaacagacugaaaaaagauuggggauugaacgaugucuggagcucuauaguauguccaagauuuaaacgauuaaaugaaauaacaaaaacuaacgcauuuggccauugggaggacaaagcuggaaaacauguauuccaaacaacugucccccuagaauuacaaaggggauuuucaaaaaaaagaaucgaccaccgacaccacgcgauggacgcguuaguaauugcaugugcuuccagaaauauaguaaacuauuuaaauaacgagucagccaauaguccugagaaaagagaagaucuacgaaagaaauuaugugaugaaaaacgaaaaauaagaaaaccauggaagacuuucacucaagaugcacgagaagcacuaagugacguaguagucucguucaaaaauuaugugcgcguaauaaacaaggcgacaaauuacuacgagcauuauucaucaucuggcaacaaaguaaugauaucacaaaaaggcaacgacaugugggccauaagaaaaccacugcacaaagaauccguuuuuggacggguaaauuuaugcaggaaagugauaguuucauuaaaaaaagcccuagaaaacauaccugcaauaugugacaagacacuacgagauuauauaaacgcucuaguagagaagcauuucaacaccagacaacugcuagcacacuuuaagucaauaaacuaucgccuuaauagacaaugugucgaaaaaguagaagucuggcaauuuagugaugagaaaauagaaaugguagccagacgaaaaagucuagacaccuccuuugacgauaaacaaaucaguucaauaacagauacuggaauccaaaaaauacuacucaacuacuuacaaacgaaagacgguaacgcggaaauagcguuuacuccagagggaauagaggagaugaauaaaaauauaucacuauacaaugacggaaaggcccaccaaccaauacucaaaguccgcgucgcaaccccaaaaggaaugaaauaccccguaggacaaacaggcaacaaggcaacaaaauucgucguagcagaaaaaggaacaaacuuauacuucgcaauauaugaaaacgaauuaggaguucgcuccuaugacacaauaccacucaacauaguaguugaaagacuuaaagaaggcuugucacccguaccgcaagcaaacgaagccgacauacccuugaaauuuuauuuaucucccaaugaucugguguacgucccaacaaaagaaaaugaagaugaguuauguagagauagaauauacaaauucguagacucauccggcaccaccgcgaacuucgucccacauacgucggcaaacacaaucuauaauguagacaaagaguacgcugaaaaaugcugcaacggagccguauuucuaaacgaguacggguuaggcucgccucaaucuaaaaaucagagagcgcuaacaggugagaugauaaaagaaauuuguuggaagcuaaaaguagaucgacuagggaauauaauaaaagugauuaaauga

SEQ ID NO: 9222 - RNA, 4530 nt, Artificial Sequence
  Cas9 variant
augaaaaauauuguuggauuagaccuagguacaaacucuauaggaugggccgucguaaacggaucaguaaacgaugacggaucggaacaauuagucaaaauucaagcaaguggcucucgaauuauaccaauggacgccgcaaugauaggcgauuuuaauaaagggaauaguauuucacaaaccgcagaacgaacuagauuacgcggaguuagaagauuaucagaacgauacuuauuaagacgcgaaagacuacacagaauucucgacauucugggcuuuuuaccauuccauuuugcacaagaucuggauagacacggaaaaaucguaaaagguaaagaacccaaacuugcauggagaaaaaaugaagcuggacaguucgaauuuaucuuucaagauucauuuaaagaaaugcuagaagacuuuaagcugaaucauccaaacuuaauaacagacgacaaaaaaguuccguaugauuggaccauauacuauuuaagaaaaaaaggauuaacuucaaaaauauccaaagaagaauuagcauggauacuguuaaacuucaaccaaaaaagagguuauuaccaauuaagaggagaagaagaaaaaaagaacgauaauguaaugauuauaaacucaaaaguaauagaugucguaaaagcagaaaaagacaaaaaauacgaaaaauauugguauaauguucugcuagaaaauggguuacuuuaccgcgccgcauucuacaacgauauaagcuuuuggaaaggccacacaaaagaauuuguauuaaaaaccauuaagcuaaagucaggcggcacaaagcaagaacuaaguuuccuacccucauucgacgaaauagagaaaauggaaaagaaacaaaaagacaaaauguacuuuaaaauaaaguuaaaaacugaggcagauauugaccaagcacauaaaaccgugggaacguacaucuaugacaccuuacuuggaaacccaagccagaaaauaagaggaagacuaguacgaaccauagaacgaaaauauuacaaagaagaauuaaaauugauacuugauaaacaaaaggaguuucauccagaacugcaggacagagcacuauaugccgccugcauugaagaacuuuauccaauuaaugaagcccacagaaacaacguaggaaaucgagacuucacauaccuauuccuagaagauaucuuauucuaccaaagaccacuaaaaucaaaaaaaucacuuaucgacaacugcccauaugaagaaaaucaaggacuagacaaagaaacaggagaaaucaagaguuuuccgguuaaauguauagcuaaaucucacccauuauuucaagaguuccgcuuguggcaauucauaguaaacuuacguauauaccggaaagauuuggcccaagauguagaugucacaaacgagcucuuaaaaacagaagaagauuauguugcacucuucgacugguuaaacgguaaaaaagaaauagaucaaaaagcguucuuaaaauauccgguauucgguuuaaaaaaagaaauugaaaacuaucguuggaacuauguacaagauaaaccauauccgugcaaugaaaccaggcuucuuaugcuagcaagguuagaaaaaugcgacauuagcauagaauuccugacaaaggagaacgaagaagcauuguggcacauauuauauucaguagaagauaagaacgaaauaguaaaagcuuuacaaaaauucgcugauaaacacgaccucaaugcaucuuucgucgauguuuuuagaaaguuuccucccuucaaaaaagaauaugguucauacucugcuaaagcgauaaaaaaauuauuaccauuaaugaggaugggaaaauauuggucggaggacuccaucgacaaagggacaagaaaacgcauggacaaaauaauaacaggagaguacgaugaaaaaauagaaaacagaguaagagagaaaguaauccauuuagccgacguaagcgacuucaggggcuuaccacuaugguuaguauguuacauaguauauggccgacauucugaagcaaaagagauaacucaguggaaaucgccagcagauauagauucauaccuaaaaucguuuaaacaacacagucuacgcaaccccauagucgaacaaaucaucauagaaacucuuagggugguacgagacauauggaaacaaguaggaaauauagaugaaauacacgucgaacuaggacgagagaugaaaaacccagcugacaaacgaaaaaaaaugacacaacagaugucagaaaaugaaaacacaaaucugcgaaucaaguauuuauugacugaauuccuaaaucccgaauacgaaguagaaaacgucagaccauacaguccaucacaacaagacauacuaagaaucuaugaagaaggcguacuuaacagcguuuccgacuuacccgaagaaaucagcgacauucuaaaaaaauuuaccgaaacagacuuaaaaaaaagaccuucaagaagugaaauauuaagauauaaacuuugguuagaacaaaaauauagaagcccauauacaggagaaguaauaccucuaggaaaguuauucacuccagcuuacgaaauagaacaugucauaccccaaagcugcuauuucgacgacaguuucaguaauaaagucaucugcgaggcagaaguuaauaagcuaaaaucuaauuugcuaggacaugaauuuauagucaaacaucauggugaaauagucgagcuaccauuuggcaaaaaaguuagaauauucacaguugaugaauacgaacaguuuguaaaagacaacuauagccgcacaagagguaaaaugaaaaaauuacuaauggaugauauaccugaagaauucgucgcaagacaacuaaaugauucgagauauauaagcaaaguaguaaaaucacugcuaucuaauauagugagagaaaagggagaggaagaggcaauaagcaaaaacguaauacccuguacuggcggaguaacagacagacuaaaaaaagauugggguauaaacgaagucuggaacaaaauuauauuaccacgauuucaacgauuaaacgaacuaacgggaacgaauaaguucacaacuaaaaacguagggauacaagaaauaccuacuaugccauuagagcuccaaaaaggauucaauaaaaaaaggauagaccaccgucaccaugcaauggaugcuauuauaauagccugcgcuaaucgaaauaucaucaacuaucucaacaaugaaucugcaacggcgaaagccgaauuaagcagauaugacuuacaaaaauuacucugcgauaaagcaaaaacugauaauaacggaaauuacaaauggguaauuagaaaaccaugggcaucauucacacaagauaccuaccucgcauuagaaaacauaauaguauccuuuaaacaaaaccuacgcguaauuaauaaagcgacaaauagauuccuccauuauaaugaagaaggaaaaaagauauucguaaaacaaggaaaaggugacaauugggcaauuagaaaaucaaugcacaaagacacaguauuuggugagguaaaucuaagacgcauaaaaacagucgcacuaaaugaggcaaugaaaaauccacaaucaauagucgugaaagauuuuaaaaggaaacuccuagaacucuggaaucucggauucgacgcaaaaagaauaaagaaguauuucgaggacaaucgugaaacauggagugauauaaacuuaucaaaaaucgaaguauauuacuuuucaaaagauacgaaggaucguuuuuuugcuacgagaaaaccauuggauacaucuuuugauagaaagaaaauugaaaauaacauaacugauacagguauccaaaaaauacuguuaagacaccuagaacuuaaagauaacaacccagacauagcauuuucaccagaugguauagacgaaaugaacagaaacaucauacaacuaaauaacggaaaauaucaucaacccauaauaaaaauaagaugguacgaacaagcggauaaauuugcuguaggacaaaccgggaacaaauuuucuaaguucguagaagcagcaaagggcaccaaucuuuuuuucgcaguauacgaaucaaauauauuggauaaaaaaacgaacacaauaauaaaaaaaagaaacuaugccacaaucccacuaaacgucgcaauagaacgucaaaaacagggacucccgguagccccugaggacgaaaauggaaaugaccccaucuucguccuuagccccaaugaccuaguauaucuccccacagaugaugaacuggccaacggaauaauagcccaaccucucgauagggggagaauuuauaaaaugguuagcugcacuggaaaugaaggccacuucauaccagcacguauagcuaacccaauacuccagaccauagaauuaggcucgaacaauaaagcgcaaaaagcauggacagacgagaugauaaaagaaauauguaugcccauaaaagucgaccguuugggcaacguauuagaaucauccagcucuuauaaaaaguga

SEQ ID NO: 9223 - RNA, 4530 nt, Artificial Sequence
  Cas9 variant
augaaacgaauucucggacuggaccugggcaccaauaguaucggauggagucuaauagaacaugauuucaaaaacaagcaaggccaaaucgaagggcucggcguucgaauaauaccuaugucgcaagaaauacuaggaaaauuugacgcaggacaaucaauaucacaaacagcagauagaacgaaauacagaggaguacgaagacucuaccaaagagacaaccuuaggagagaaagacuacacagaguacuaaaaauccucgauuuuuuaccgaaacacuacucggaaucaaucgauuuccaagacaaaguuggucaauuuaaaccgaaacaggaaguaaaacuuaauuauagaaagaacgaaaaaaacaaacaugaauuugucuucaugaauucauuuauagaaaugguuagcgaauucaaaaacgcacagcccgagcucuuuuauaauaaaggcaauggagaggagaccaaaauuccauaugauuggacacucuauuaccuucgaaaaaaagcacuaacucaacaaauaaccaaagaagaacuagcauggcucauacuaaauuuuaaccaaaaaagaggauacuaucaguugcgaggagaagauaucgacgaagauaaaaacaaaaaauacaugcaacuaaaaguaaauaaccuuaucgauagcggagcuaaagucaaaggcaaaguccucuauaacguuauauucgauaacgguuggaaguacgaaaagcagaucguuaauaaagacgagugggaaggccgaaccaaggaauuuaucauaacaacgaaaacacuuaaaaauggaaauauaaaaaggacauauaaagccguagacagcgaaauugacugggcagcgauaaaggcaaagaccgaacaagacauuaacaaagccaauaagacgguuggagaauacauauacgagucucuacuggauaaccccagccaaaaaauaagaggaaaauuggucaaaacaaucgaaagaaaguuuuacaaagaagaauucgaaaaacuauuaucaaaacaaauagaacuacaaccagaauuauucaaugagucguuguauaaagcgugcauaaaagagcuauacccgcgaaaugaaaaucaucaaucuaacaauaaaaaacaaggauucgaauaccuauuuacagaagacauuauauucuaccaaaggccauuaaaaagccaaaaaucuaauauauccgggugccaauuugaacacaaaaucuacaaacaaaaaaauaaaaaaacuggaaaauuagaauuaaucaaagaaccaaucaaaaccauaucaagaucccauccccucuuccaagaauuuagaauuuggcaaugguuacaaaauuugaaaauauauaacaaagaaaaaauugaaaacggaaaacuagaggacguaacaacccaacuucuuccaaacaaugaggcauacguaacacucuucgacuuucuaaacacaaaaaaagaacucgaacaaaaacaauucauugaauacuucguuaaaaagaaacuaauagauaaaaaagaaaaagaacacuuuagguggaacuuuguagaagauaaaaaauacccauucucugaaacuagagcccaauucuugaguagauuagcaaaaguuaaagguauuaaaaacacggaagauuuuuuaaacaaaaauacgcaaguuggaagcaaagagaacucaccauucauaaaaagaauagaacaacuauggcacauaauuuacaguguauccgaucuaaaagaauacgaaaaagcuuuagaaaaauucgcagaaaaacauaauuuagaaaaggacaguuuccuaaaaaacuuuaaaaaauuccccccuuucguaagcgacuaugccucauacucaaaaaaagcuauaagcaaauuauugccgauaaugagaaugggcaaauauuggucagaaagugcagucccaacgcaggucaaagaaagaucauuaucaauaauggaaagaguuaaaguccuaccauuaaaagaaggauacuccgauaaagauuuggcagaucucuuaucuagaguaucagacgaugauauucccaaacaacuaaucaaaucguucauuaguuucaaagauaaaaauccuuuaaagggcuuaaauacuuaccaagcgaacuaccuaguuuauggcagacauucugaaaccggagacauacaacacuggaaaacaccagaagauaucgaccgauaucucaacaacuucaaacaacacagucuaaggaacccaaucguagagcaaguaguaauggaaacacuaagggugguaagagauauaugggaacacuauggaaacaacgaaaaagacuuuuucaaagaaauccauguagagcuugguagggaaaugaaaucgcccgcaggaaaacgcgaaaaacucucacaacgcaacacagaaaacgaaaauaccaaucauaggauacgcgaaguauuaaaagagcuaaugaaugaugcuagcguagagggagggguaagagacuacaguccaucgcaacaggaaauccuuaaauuauacgaagaagguaucuaccaaaauccuaauacaaauuaucuaaaaguagaugaagacgaaaucuuaaaaauaaggaaaaagaauaauccgacucagaaagaaauccaacgauacaaacuaugguuggaacaaggcuacaucagucccuacacuggaaaaauuaucccgcucacaaaauuauuuacacacgaauaucaaauugagcacauaauaccacaaucucgcuacuacgacaauagccuaggcaacaaaauaauaugcgagucagaagugaaugaagacaaagauaacaaaaccgcauacgaauaccugaagguggaaaaaggaucaauaguuuucggucauaaacuauuaaaucucgacgaauaugaagcucacguaaauaaguacuucaagaaaaacaaaacaaaacuaaaaaacuuacuaucagaagacauaccugaaggauucauaaauagacaauuaaacgacucacgauauaucucaaaauuaguuaagggacucuuaucaaacauuguucgagaaaacggagaacaagaagcaacaucaaagaacuuaauacccguuacaggaguaguaacauccaagcuuaaacaggacuggggacugaacgauaaauggaacgaaauaauagcaccgagauucaaacgacuaaacaaacuaacaaacucaaaugacuucggauucugggauaaugacauuaacgccuuccgaauacaagucccagauucacuaauaaaagguuuuagcaaaaaaagaaucgaucauagacaucacgcacucgacgcacuaguaguagcauguacaucuaggaaccauacacacuacuugagcgcauugaacgccgaaaacaaaaacuacagcuuaagagacaaacuagucauuaaaaacgaaaauggcgacuacacaaaaacguuccaaauaccguggcaaggauucaccaucgaagccaaaaacaacuuagaaaaaacaguuguaaguuucaaaaaaaaccuaagagugaucaauaaaaccaauaauaaauucuggagcuauaaagacgaaaacggcaaccuaaauuuaggaaaagaugggaaaccuaaaaaaaaacuaagaaagcagacaaaaggauacaacugggcaauucgcaaaccacuucauaaggaaacagucucagguauauacaacauaaaugccccaaagaacaaaauagcuacaucaguccguacacucuuaacugaaauaaaaaaugaaaagcaccuagccaaaauaacugacuugagaaucagagaaacaauauuacccaaccaccuaaaacacuaccuaaauaauaaaggcgaagcaaacuucuccgaagcauucucacaaggagguauagaggacuuaaauaaaaaaauaaccacacuaaaugaaggcaaaaaacaucaaccaauauaucgaguaaaaauuuucgaagugggcagcaaauucucgauauccgaagaugaaaacagugcgaaaucaaaaaaauauguagaagcagcaaaggguaccaaucuuuucuucgcgauuuauuuagacgaagaaaacaaaaagaggaauuaugaaacaauuccacuuaacgaagugauuacccaucaaaaacaaguagccgguuucccuaaaagcgagaggcucucagugcaaccagauucacaaaaagguaccuuccucuucacauuaaguccuaacgaccucguauauguaccaaauaacgaagaacucgagaaccgagaccuuuuuaaccuagguaaucuaaauguagagcaaaucagcagaauauauaaauucacugauucauccgauaaaacaugcaauuuuauuccauuucaagucuccaaacucaucuuuaaucuaaagaaaaaagaacaaaagaaacucgaugucgacuuuauaauccaaaacgaauucgguuuaggaucuccacagaguaaaaaucaaaaaucuauagaugauguaaugauaaaagaaaaaugcaucaaauuaaaaauagacagacuagguaacauaucaaaagcauga

SEQ ID NO: 9224 - RNA, 4530 nt, Artificial Sequence
  Cas9 variant
augaaaacgauucuaggccucgaucuagguaccaauucaguagggugggcaguaauaaauucuguuauaaaagagcaggcagaacguauauggaucgaaauggccgguaguagaauaauaccaauggaugcagcaguacuaggagacuuugauaaagguaauucaauaagucaaacaucagaaagaacccgauuaagaggaguaagaaggcugcgagaaagacaacuacuaaggagggaacgucugcauaagguacuaaauauacuaggcuucuuaccuaaucauuacuuagaauacauagacuuugagaaacacccuggaaaauucuugagugacgcagaaccuaaacugccauggguuaaagaugagcaaggaaaauauacuuucuuauuccaggcagcauuugaugaaaugcuagcagacuuugcaauacaucaaccuucgcucgugucuggagauaagaaaauaccuuaugauuggacaauuuacuaccuaagaaaaaaagcucuaacagaaaugauaagcaaagaagaacuagcauggauuuuacuaaauuucaaucaaaaacgaggcuacuaccaacuacgaggugaagaagaagaagauaacgcaggaaaaagcgucgaauucuacgcauugaagguauugacuguugaagcgaccgaugaaaaaaaaggaagagacgugugguacaauguacacuuagaaaauggauggauauaccggaggagcucuucuguaccacuagacugggaagggcaaauuaaagaauucaucguaaccaccgauuugaauccagacucaacacccaaauuagacaaauacggagagguaaagcguucauucagagcuccaaaggaagacgauuggauguuaauaaaaaaaaggaccgaggcagauauugcaaauacgcauaaaaccguuggagcuuacauauaugacacguuacuucagaaaccacaacaaaaaauaaucggaaaguugguaaaaaccguggaaagaaaacuauauagagacgaauuaucgcuaauauuacaaaaacaaugcgccuuccaugcugaauuacaagacagaacguuauacgccagguguguagaggcuuuauauccaaacaaugaaguccagagacggaauauagcaaacagggacuucguauaccuguuaauggaugauguauuguuuuaucaaagaccauuaaaaacaaaaaagagccuaauagcgaacuguccauaugaagaaaaugaauacguagaucgagaaacaggagaaaucaagaaagcaccacuaaaaugcauugcgaaaucacacccacuauuucaggaauuucgucuauggaacuucuuaagcaauauucgaauauaucaaaaagaaaaagaaauaaaugggacacuacauuuggauguagacgucacagcagaguuuuugaaaacagaagacgauuauguagcucuguuugauuggcuaaacagcagaaaagaaauagagcaaaaaacuuuccuaaaauaucccaaauuuggacuuaaaaaagaaauaucaaauuacagauggaacuauguugaagauaagcaauaucccuguaaugaaacucgacaugccauauuaaguagguuagaaaaagcaaacguauguauagauuuccuauccaacgaaaaagaggucgcacuauggcacauacuauauucgguaagcgacaaacaagaaauagagaaagcguuaagaacuuuugcagcaaaaaacggauuagaugaaaguuucgucgaagcuuuuaaaaaauuuccuccauuuaaaucagaauacggagcauacucggccaaagccauaaaaaaacuacuaccacuaaugagaugcggaaaauauugggacgucaguaguauagacgauacaacaaaggagagaauaaaaaaaaucguagcaggcgaauaugacgagagaauagccguuaaaguaagagauaaagucaugaaucuaucagauauauccuguuuuaaaagauugcccuuaugguuggcaugcuacauaguguacaauagacacagugaggauaaagaggcuguaaaaugggaaagccccgcugauauagaugccuaccuugcaaguuuuaaacaacacucacucagaaacccgauaguagaacaagucauaacagagacacugagaguuguacgagauauauggaagcaaguagggagaauagacgaaauccacauagaacucggcagagaaaugaaaaauccugcugacaaaagaaaaagaaugacagcacaaaucuuggaaaacgaaaaugcaaaucucaggaucaaagcacuauuggcagaauucaugaauccagaauaugaaauagaaaacguacgaccauacucuccgucacaacaagaaaucuuaagaauauaugaagauaugguguugcacgccgaggaucaacugccagaagaaaucgaugcaaucuuaaagaaguuuaauucaaguaaaguaccaaccaaaucagaauuucugagauauaaauuaugguuagagcaaaaguacagauccccauauaccggggaauuaauaccucuagguaaauuauuuacagcagcauaugaaauagaacacguuauaccucaaagucgauauuucgaugacaguuucagcaacaaaguaauaugugaaucugcagucaauaaacucaaagauaaucaauuagguuaugaauuuaucaaaaaccaucauggacaaaaaguugaaguaggguuuggcaaaucuguggaaaucuucucaguugauaguuacgaaagguucguuaaagagcaauacgcuaaauccgccguaaaaaugaaaaaaaugcuaauggaugauauaccugaacaauuuauagaaagacaacuaaacgacucgagauauauaucaaaaguaaucaaaggacuacuuagcaauauaguaagagaaaaaaaugauagcggagaauaugaaccugaagcagugagcaaaaacauaguuguaugcacaggaucggugacugacagguuaaaaagagauuggggaaugaacgacguauggaacucgauaguauaccccagguuugaacgauuaaacagccuaacugacacacaaucauucggacauugggaaaacaagucaggaaaaaaaguauuucaaaccgaacuuccgcucgaauaccaaaaaggauucucaaagaaaagaauugaucacagacaucaugccauggaugcaaucgugauagccugcgccacgcgcaaucauguaaauuaccuaaguaacgagucagcaagccgaaaugcuaaaauaagucgguaugacuuacaaagacugcuaugugacaaauccagaacagaugacaacgguaauuacaaauggguuauaaaaaaaccaugggacacauucacgcaagaugcacgugaaguucuaucaaaaauagucgugucacuuaaacaaaacuuaagaauaauuaacaaaacaacuaauguuuacagacauuuggaugcaacuggcaaccgaguauaugaaaagcaaaagacuggagacucuugggcaauacggaaaccuaugcauaaagacacaguauuuggugcuguaaaucuuagaaaaguuaaaguaguacgacuaaguguagcccuugacgcuccaacgaugauaguugacaaacgaguaaaaaacaaaguauuugaacugcuuucauacaaauaugauaaaaaaagaauagaaaaguauuucaaagaaaacgccguauuauggaaagaauuagaccuggcacgaguugcgguuuauuauuucacagaggcaacaacagagccauuaguugcaguaagaaaaccgcuggacucgacuuuuaaugaaaaaaaaauaaaagaaucgguuacagacaccgguauacaaaaaauacuacuaaaucaucuuugcacaaaggaaggaaaaccagaccuagcauuuucugcagaaggaauugaagaaaugaacagaaaccuuuugcaacugaauaacggaaaaagacaccagccgauauauaaagugagagucuacgaaccuaggggaaacaaauuuagugugggaguguugggaaauaaaggaacuaaauggguugaagcugcaaaaggaacuaaucuauuuuucgcgauuuauauaaccgaggacgggaagagaacauacgaaacuauaccccuuaauaugguaaucgaaagggaaaaacaaggacucgcaccaguaccugauaagaacgaaaaaggagacaaacucuuguuuuggcuaagcccaaacgaccuaguauaucuaccuacggaagaagaauuggaguuuggaagaauuaacgagcccauugauagaggccgcauauauaaaaugguuagcaguuccggcaaucaauguuuuuuuauaccccaguccauaagcaacgcaauuauacccacaaaagaacuaggagcaaauaauaaggcagaaagaagcugggacggugcaaugauaaaaaauaucuguauccccgucaagguugauagacuggguaggaucauagaaguaaaauauagaaucaaugaauga

SEQ ID NO: 9225 - RNA, 4530 nt, Artificial Sequence
  Cas9 variant
augaaaacgauauuagggcuagacuuaggcaccaauucaguaggaugggcuguaaucaacucgguaauaaaagaacaagccgaacguauauggauagaaauggcaggaucuagaauaauaccaauggacgcggcaguucuaggcgacuuugauaaagguaacucaauaucacaaacuagugaaagaacacggcuaagaggagcacgacgccuaagagaaagacaacugcuacgccgggaaagacuacauaaaguacucaauauucuuggcuuccuuccuaaucacuaucucgaguacauagauuuugaaaaacacccaggaaaauuucuugcugacgcagaaccuaaauuagcuugggucaaagaugaacagggaaaauacacauuccucuuccaggcagccuuugacgaaaugcucgcugauuucgcuauccaucaaccgucccuagucuccggagacaaaaaaauaccuuaugacuggacaauauauuaucuacgaaaaaaagcucuuacggagaugauuucuaaagaagagcuagcguggauacuauugaauuuuaaucaaaaaagaggcuacuaucaguugaggggagaagaagaagaggacaaugcaggaaaaucuguugaauucuacgcacuaaaaguguuaacaguagaagcuacagacgaaaaaaaaggacgagauguaugguacaacguacaccuagagaacggauggauauauaggagaaguaguagugucccauuagauugggagggacagguuaaagaauucauuguaacaacagacuuaaauccugauggcacaccaaaauuagacaaauauggagaaguaaaaaggucuuuuagagcgccgaaagaagacgauuggauguuaauuaaaaaaagaacagaagcagacauagcaaauacacacaaaacagugggagcguauaucuaugacacccuacuacaaaaaccucaacaaaaaauaauaggcaaguuagugaaaacuguagaacgaaaacuauaccgcgacgaauuaucauugauacuacaaaaacaaugcgccuuccaugcagaacugcaagacagagcccuauacgcucgcuguguagaagcuuuguacccgucuaaugaaguacgaaggaaaaacauagcaaauagagauuuuguguaccucuuaauggaugauauacuuuucuaucagagaccauuaaaaacaaagaagucauugauagcaaacugcccauacgaagaaaacgaauauguugacagagaaaccggagaaauaaagaaaacaccuuuaaaguguauagccaaaucacacccgcuauuucaagaauuccgauuauggaauuuuuuaaguaauauucgaauauaucaaaaagaaaaagaaauaaacgguacccuacaucuagacguagacguaacagcagaauucuuaaaaacagaagacgauuauguggcccuuuucgauuggcugaauaguagaaaggaaaucgaacaaaaaaccuuuuuaaaauauccuaaauuugggcuaaaaaaggaaauaucuaacuacagguggaauuaugucgaagauaaacaauaucccuguaacgaaacgcgacacgccauacugucuuccuuagaaaaagcuaauguuuguauagauuuucugucuaaugaaaaggaaguugcucuauggcauauacucuauagugucucagacaaacaagaaaucgaaaaagcacuaagaacauuugcggcaaagaauggacuugaugaaagcuucgucgaagccuuuaaaaaauucccaccauucaaaucugaguauggagcauauagugccaaagcaaucaaaaaaauguuaccucuaaugcgcuguggaaaauacugggaugucucaaguaucgaugauacaacgaaagaaagaaucaaaaaaauagucacuggagaauacgaugagagaauaucagugaaaguccgagauaaagucaugaaccugucagacauaagcuguuuucgccgccuaccuuuauggcucgcaugcuauauuguauacaauagacacucagaagacaaagaagcugugaaaugggaaaguccagccgauauagaugcauaucuugcgaguuuuaagcaacauucauuaagaaacccgaucguagaacaaguaauuacggaaacacuucguguaguacgugacauauggaaacaaguaggccgaauagaugaaauacauauagaacucgggagagaaaugaaaaaccccgcugauaaacgcaaacgaaugacagcucaaauccucgaaaacgaaaacgcaaauuuacgaauaaaagcacuuuuagcugaauuuaugaacccagaauaugaaauagaaaacguaagaccauacucaccgagccaacaagaaauacuucgaauauacgaagacacaguccuacacgcagaggaucaguuaccagaagaaauagacgcgauauugaaaaaguucaauucaucaaaagugccaacaaagucagaauuucuacgauauaaauuaugguuagaacagaaauauagaucucccuauacaggugaauuaauacccuuaggcaagcuguuuaccgcagccuacgaaauugagcacguaaucccgcagucacgcuacuucgaugauagcuuuuccaacaaaguaauuugugaguccgcuguaaacaaauuaaaagauaaucaacuaggauacgaguucauaaaaaaucaucacggacaaaaaguggaggugggcuuugguaagucaguagagauauuuagcguagacucguacgaaagauuuguaaaagaacaauaugcaaaaagugcaguaaaaaugaaaaaacuuuuaauggacgauauaccggaacaauucauugaacgacaacucaaugacucaagauauaucuccaaaguuauaaaaggccuauuaagcaauauuguucgagaaaaaaacgauagcggcgaauacgaaccugaagcaguaucaaaaaacauuguuguauguacaggaagugugacugaucgacuaaaaagggacugggguaugaaugauguauggaacaguaucguguauccuagauuugaaaggcuaaacagcuuaacggauacacaaucauuuggacauugggaaaacaaaucuggcaaaaaaguauuccaaacugaguuaccauuagaauaucagaaagguuucuccaaaaaaaggauagaucacagacaccacgcaauggaugcaaucguaauugcaugugcaacacgcaaucaugucaauuauuugucaaaugaaagugcaucaaggaaugcaaaaauaucaagauacgauuuacaaagacuguuaugcgacaagaaucguacagacgauaacggcaacuacaagugggucauaaaaaaaccaugggacaccuuuacacaggaugcgagagaaguauuaucuaaaauaguaguaucccuaaagcaaaauuuacguauaauaaauaaaacaacaaacguauauagacaccucgaugcuacaggaaaccgaguauaugaaaagcaaaaaacuggagacucaugggccauacgaaaaccuaugcacaaagauaccguuuucggugccgucaauuuaagaaagguaaaaguuguaaggcuauccguugccuuagauacgccagccaugaucguagacaaaagaguaaaaaacaaagucuuugaacuauuauccuacaaauacgauaaaaaaagaaucgaaaaauauuucaaggaaaacgccuuuuuauggaaagaacuagaucucgcgaaaguugccguguacuauuucacggaagcaacaacugagccauuaguggcaguaagaaagccacuagacucaacauucaacgaaaaaaaaauaaaagaaaguguaacugauaccgguauucaaaaaaucuuauuaaaucaucuuuguacaaaagaaggcaaacccgaucuagccuucucagccgaaggcauugaagaaaugaaccgaaacuuauuacaauugaauaacggcaaaagccaucaaccuaucuacaaaguacguguauaugaacccagaggaaauaaauucaguguugguguacucggaaacaaagggaccaaauggguugaggcugcaaaaggaacaaaccuauucuucgcaauauacauaacagaagaugguaaaagaacuuaugaaaccaucccacuaaauguaguaauagaacgagaaaaacaagguuuaguaccagugccugacagaaacaagaaaggagauaaacuucucuucuggcuaagcccuaacgaccuaguauacuugccaaccgaggaagaaagagaauucggaagaauuaacgaaccgauagacagaggcagaauauauaaaauggugucaugcacagguaaugaaggacauuucauacccgcaaauguagcaaauccaaucguuccagugaucgaacuaggaucuaacaacaaagcacaaagagcuuggacuaacgaaaugauaaaagacauuuguaucccaauuaaggucgauagacuggggcacauuauugaaguaaaauauagaauagaugaauga

SEQ ID NO: 9226 - RNA, 4530 nt, Artificial Sequence
  Cas9 variant
augaagaaaauacuuggccuagacuuggggaccaauucagugggaugggcaguaauaaauagcgugguaaacgacgaagguaaagaacaacuuguaaauauaucuagcuguggaaguagaaucauaccgauggaugcggcaacacuaggagacuuugauaaagguaacucuaaaucaccaguagcagaaagaacucgacuaagaggagucagaagacucuuagaaagaagucuacuaagacgagaaagauuacauagaguucuaucagucaugggauuucuaccagaacacuaugcagcgcaacucgaucgguaugguaaauuccuuccagaaacugaaccuaaacuagccugguacaaagaugaaacaggcaaauaccgauuuuuauuucaagauucguuuaaugaaauguuagaagauuuucacgaacaccauccagaacucgucgcagaaggaaagaaaauacacuaugacuggacaauauauuacuuaaggaaaaaggcuuuaucacagaaaauaacuaaagaagaacuugcauggauacuacuaaauuuuaaccagaaacgugguuauuaucaauuaagaggagaagaagaacaagaagauaacaagaaaucaguagaauauuacgcuuugaaagugguagcaguagaagacucuggcgauagaaaagguaaagauauuugguauaaugucaaacuagaaaacgguuggguuuaucgacgugcaucaggcguaccacuugauuggguugguaaaguuaaagaguucauaguaacuacagacuuagacgaaaaaggcaaucccaagaaagauaaagauggcaaugugaaacgauccuuuagagcaccaaaagaagaugacuggggacuacuuaaaacaagaacacaagcacaaaucgacgaaaguggacaaacaguaggaacguacauauacgaaaguuuacugagaaugccagaucagaaaauucgagggaaauuaguacggacaauagaaaggaaauauuauaaagaugaacuaaggaaaauauugauaaaacaaagugaguuccacacagcauuacaagaccauaauuugcuacuagcauguauugaagaacuuuaccccaacaaugaggcacauagacguuuacuaagcaccagugauuuuacauacuuucuaguggaagacauccuauucuaccaacguccccucaaaagccaaaaaggccaaaucgacgacuguccuuacgaaagucacguuuacagggauaagaaagacggaucauuacaacaugucccacuaaaauguguaucgaaaucacauccucuuuuccaagaguuuagacuauggcauuuucuuaguuuucugagaauauaccaacgagagcguaugauugauggaaguuuaaaacuagaugucgacguaacgaaugaauuuuuacaaaacgaggaugacuauguaaaacuauuugauuggcugaacgaaaggaaagaaauugaccagaaaacuauauuggcguauaaaccauuuggccuaaagaaaaacgaacaaucaaaauauagauggaauuacgucgaagacaaaucauacccuuguaauagcacacgggcugacaugaucuucagauuaucaaaagcaggaguaccagaagaguuccuaacaagagaaaaagaagaagcccuauggcacauauuauacucgaucucagauaagaaagaacucaccaaagcacucggaacauuugcugagaaaaauggauugaaugaaacauucguugagauuuucucaaaaaugccaccauucgaauccgacuaugcugcauacucauugaaagcuauaagaaaacuauuagccuuaaugcguaugggaaaauauugggacgaacaagcaauugacgagcauacaagaagcagaauagagaaaauacuuacaggcgaauacgaugaaacaaucagaacaagagucagagaaaaagcgaugcauuugacugauauaagcagcuucagaggccuaccgcuauggcuagcaugcuacguagucuacgaucgucauagugaagccaaagaauugguaaaaugggaaaccccugacgauauagaccacuuuuuacgcaaauuuaaacaacauagucuuagaaauccaauaguagaacaaauuauaauggaaaccuugagaacgguaagagauauauggaaacaagagggaaaaaucgaugagauacauguagaacugggacgagagaugaaaaaucccgcgaaagaacgagcgagaauuacagcacaaguucuagaaaaugaaaacacaaaucugagaauaaaagcauuacuagcagaauuuaugaauccggaguucgaaauagaaaacgucagaccauacucuccagcucaacaagaaauucuaagaaucuaugaagaaggaguccuaucagggguagcagagaaagaucuacccgaugauauugcgucaauucuuaagaaauuuagagaaaaugacguuaagaaacgacccacaaccucagaaguacuaagguacaaauuauggcuagaacaaagauaucgaaguccauauacuggacgaauuauaccacuuggcaaauuauuuacucccgcuuacgaaauugaacacguaauaccucaaucgagguauuucgacgacucauucacaaacaaagucauaugugaaagugcaguaaacaaauuaaaagacaacugucuaggcuacgaguuugucaagaaacauucuggagaaaaaguagagcuaggaaauggagagacagccacaaucuucucaguugaagaauacgaacgauuuguuaaagauaguuacuuuaacaacagcaagaaaaucaagaaacuauugcuagaagauauaccagacaauuuuauagaaagacaacuaaacgacucacgauacauaucaaaagugguaaaaucgcuacugucaaauauaguuugugaagaaggugaacaagaagguaugucuaagaacguaauagucuguacaggaggugucacagacaggcuaaagaaagauuggggaguucaagacgucuggaaccggauaauuuuaccuagauucuuacgucuaaauaaaaugaccgacagaacagacuuuacagcaguaagcacaaacggacaucuuuuaccggcgguaccgcuacauuuacaaaaaggauuuaauaaaaagagaaucgaccacagacaccaugcuauggaugcaauaguaauagccugugcaggaagaaauauaguaaauuaucugaacaacgcaagcgcacgaaaagggagcgagaucucaagauaugauuugcagcaccuucuaugcgauaaaguuaagacagacgcgaauggcaacuauaaauggauacuucgaaagcccugggaaacuuuuacccaagaucuauaugcggcacuuacaaacauaguuguaucauucaaacaaaaccucagagucauaaacagaacuacaaaccauuaucaacacuacaaugaagauggagagaaaaagaugauaccacaaaccaaaggggacagauuagccauaagaaaacccaugcacaaagauacuguguacggugaaguaaacuuaagaaaagagaaaacucuaccguuaaaggauguagucaaaaauccaagcgccguaguugauaaaucacucaaaaacaaacuauaugaauuauuaaaaucacaauacgaccuaaaagcaauaacaaaauacuuugaaacccaccaagauguaugggccgauguaaacuuaaagaaaauaaaaguuuauuacuuuaccaaagaaacgaacgaaagauuuuucgcuacuagaaagagcuuagauucuucuuucagccagaagaaaauagaagaagaaguaacugauacuggaauacagaaaauccuauuaagacaucugcaacaaaauggcaauaauccagacauugcuuuuucaccagacgguguagaaagaaugaaccaaaacaugacaauacuuaacgacgguaaauggcaucaaccaauauauaagguacgcacauaugaaaaggcugacaaauucgcaguaggagaaaaaggaaacaaaguaaagaaauuuguggaagcagcuaaggggacaaacuuauucuuugcgguuuaugagaguauacaggaagacgaggcgacaggcaaacagguaagaaaacgaacauuugcuaccauaccacucaaugaaguuauuaaaaggaagaaacaaggguuaccagcagcacccgaagauaguaaaggcaaucuucccaucuuuguucugucaccgaacgacuuaguguaccucccaacagaagaagaaagaaauaguggaaaaauaauucaaccgcuagaucgugaaagaauuuauaaaaugguaaguuguaccgaaggagaaugucauugcauaccugaauacguagcaaauccaauccuccaaacaauagaacucggcuccaauaauaaagcccaacgcgccuggaguggugaaaugauaaaagaaauauguguacccguaaaaguggaccgacuagguaauguuucauuaauuaaaauauga

SEQ ID NO: 9227 - RNA, 4530 nt, Artificial Sequence
  Cas9 variant
augaaaacuaucuuaggucuagaucucgguaccaacucagugggaugggccguaauaaacucaguaaucaaagaacaagcagaaagaauuuggauagagaccgcaggaaguagaaucauacccauggacgcagcgguuuuaggagacuucgacaaaggaaacagcauaucucaaacauccgaacgaaccagauuacguggagcaagaagacucagggaacgacaauuacuacguagggaaagauugcacaaaguucuaaauauacuuggauuucuuccaaaucauuacuuagaauauauugauuuugaaaaacacccaggaaaauuucuugccgaugcagaaccaaaauuggcuuggguuaaagacgaacaaggaaaauacacauuuuuauuucaggccgcauuugacgaaaugcuugcagacuuugccauacaccaaccaucauuaguaagcggagacaagaaaauaccauaugacuggacaauuuacuaucuuagaaagaaagcuuugaccgaaaugauaagcaaagaggaacuugcauggauauuacuaaauuucaaucaaaaaagggguuauuaucaacuaagaggugaggaagaagaagacaacgcgggaaaaucaguugaauucuacgcacuuaaaguauuaacgguggaggccacagaugaaaaaaaaggcagagauguuugguauaauguacauuuagaaaacggguggauauacagaagaagcagcuccguaccauuggacugggaaggacaagucaaagaauucauagugacaacugacuuaaacccagacgggacuccuaagcuagauaaauauggugaaguaaaaagaucauuccgcgcaccgaaagaagaugauuggaugcuaauaaaaaaacgaacagaagcagauauugcaaacacccauaaaacaguaggagcguauauauaugauacacuauuacaaaaaccucaacaaaaaauaaucggaaaguuaguaaaaacagucgaacgcaaauuauauagagacgagcucucucucauacuucaaaaacagugugcuuuucacgcagaacuacaagacagggcucucuaugcgcgaugugucgaagcccucuacccaagcaacgaaguaagaagaaaaaauauagcaaaucgugacuucguguacuuauuaauggaugauauuuuauucuaucaaagaccacuaaaaacaaagaagucacuaaucgcgaacugcccuuaugaagagaaugaauauguagacagagaaacuggagagauaaaaaaagcuccacucaaaugcauugcgaaaucacacccacuauuucaggaauuccgucuauggaauuuuuuaagcaacaucagaauuuaucaaaaagaaaaagaaauaaauggaacgcuccaucucgacguugacguaacagcugaguuccugaaaaccgaggaugauuauguagcacuauuugacugguugaacucaagaaaagaaaucgaacagaaaaccuuuuuaaaauacccaaaauuuggacucaaaaaagaaaucaguaacuacagauggaauuacguggaagauaaacaauacccaugcaaugaaacucgacaugcuauauugaguucacuagaaaaagcaaacguuuguaucgacuuccuuucaaaugaaaaagaaguggcuuuauggcacauacuauacucuguaucggacaaacaggaaaucgagaaagcgcuaaggacuuucgcagcaaaaaauggguuggaugaaucuuuuguugaagcguuuaagaaauuccccccuuuuaaauccgaauauggagcauacucagcuaaagcuauaaaaaaaaugcuaccgcuuaugcguuguggaaaauacugggauguaaguucgaucgaugauacaaccaaagaaaggaucaaaaaaauagucaccggagaauaugaugaaagaauugccguaaaaguacgggacaaaguaaugaaucuguccgacauaucauguuuuagaagauuaccacuaugguuagcgugcuacauaguauauaacagacacucagaagauaaagaagccgucaaaugggaaagcccggcugacaucgaugcauauuuagcgagcuuuaaacaacauucccugagaaauccaauuguagaacagguuauaacagagacauuaagaguaguuagagauauuuggaaacaaguaggaagaauagacgaaauacauauagaacugggaagggaaaugaaaaauccagcggauaaacgaaaaagaaugacagcccaaauacuagaaaacgaaaacgcaaauuuaagaaucaaagcgcucuuggcagaauuuaugaaucccgaguaugaaaucgaaaacguuagacccuauucaccgagccaacaagaaauucuucguauauacgaagauacaguccuacaugcggaagaucaauuaccagaagagauagaugcuauacuaaaaaaauuuaauaguaguaaaguaccaacaaaaagugaauuccuaagauacaaauuaugguuagaacaaaaauauaggucaccauacacaggagaauuaauaccacuaggaaagcuguucacggcggccuacgaaauagaacacguaauuccacagucaagauauuucgaugacucauucagcaauaaagucauaugcgaaucagcaguaaacaaguuaaaagacaaucaauuagguuacgaauucaucaaaaaucaucauggacaaaaagucgaaguaggauucgguaaaagcguagagauauucucaguagauucauacgagagguucguaaaagaacaauacgcaaaaucagccguaaagaugaagaaacuacuaauggaugacauuccugaacaauucauagaacgacaacucaacgacaguagguauauaucaaaaguaaucaaaggacuuuuaucuaacauuguaagagaaaagaacgauucuggagaauaugagccagaagccguuaguaaaaacaucguaguuugcacuggcagcgugaccgauagacuaaaacgagauugggguaugaacgacgucuggaauuccauugucuauccgagauucgaacgcuuaaacucccugaccgauacacagaguuuuggucauugggaaaauaaaucuggaaaaaaaguuuuucaaacugaguuaccgcuagaguaucaaaaaggguuuaguaaaaaacgcauagaccacagacaucaugcaauggaugcuauaguaauagcaugugcgaccaggaaccaugucaauuauuuaucuaaugagagcgcuucccgaaaugcaaagauaagccgauacgaccuacagagacuacuuugugauaaaaacagaacugacgacaauggcaauuacaaaugggucauaaaaaaacccugggacacauucacucaagaugcacgagaggucuuaucuaaaauugugguaagucuaaaacagaaucuacgaauaauaaauaaaacaacgaacguauaucggcacuucgaugcuacaguuaacagaguauacgaaaaacagaaaacaggagacaguugggcaaucagaaaaccuaugcauaaagauacagucuucggagcgguaaauuuacgaaaaguaaaaguggucagguuaagcguagcuuuagauacaccggccaugauuguagacaaaagaguaaaaaacaagguuuucgaacuacuaucauauaaauaugauaaaaaacgaauagaaaaauacuuuaaagaaaacgcauucuuauggaaggaacuugauuuagccaaagucgcaguauacuacuucacagaagcaacaacagaaccuuuaguagcaguaagaaaaccacuagacagcaccuuuaaugaaaaaaagauuaaggaaucagucacagauaccggaauacaaaagauauuauuaaaccauuuauguacaaaagaaggaaagcccgauuuagcauuuucugcagaagguaucgaagaaaugaauaggaacuugcuacaacucaacaauggaaaaagccaccaaccaaucuacaagguaaggguauacgaaccucggggaaacaaauucaguguaggaguccucggaaauaaaggaacaaaauggguagaagcagcaaaaggaacuaaccuauucuucgcuaucuacauaacagaagacggaaagcgaacauaugaaacaauaccccugaauguaguuaucgaacgagaaaaacaaggauuaguacccgucccagacagaaacgaaaaaggggacaaacuacucuucuggcuaucacccaaugaucuuguuuaccucccaacugaagaagaaagagaauucggaagaauaaacgaaccaauugacagaggacgcauauauaaaaugguaagcuguacuggaaaugaaggacauuucauaccggcaaauguagcaaacccuauuguaccuguaauagaacuuggauccaacaauaaagcacagagagcauggaccaacgaaaugauuaaagacauuugcauaccaauaaaaguugauagacuuggacacauaauugaagucaaauauagaauugacgaauga

SEQ ID NO: 9228 - RNA, 4530 nt, Artificial Sequence
  Cas9 variant
augaagaaaacucuaggauuagauuuaggaacaaauucaauagguugggcaguaauaaacucaaauauagacucggaagguaaagaaaaacugguaggcaucucauccuguggaucgagaauaauaccaauggaugcaaccacucuaggcgacuucgguaaaggaaauacaaaauccccaguagccgaaagaaccagacuaagagguauaaggaggcuacuagaaagaucauuacuuagaagagaaagauuacaccgaguauuaaguguaaugggcuuucugccagaacacuacgcaucacaauuagacagauauggaaaauuucuaccugaaacagaacccaaacuugcaugguacaaagacgauucaggccgauaccaauucuuauuucagaaaaguuuucacgaaauguuagaagauuuccgccaacaccaaccugagcuaguagccggggaaaagaaaauuccguaugacuggacgauauauuacuuaaggaagaaagcccugucucaagaaauaaccaaagaagaacuagcauggauucuccuaaauuucaaccagaaaagagguuacuaucaacucagaggagaagaagaacaagaagaaaauaauaaaucaguugaauaucacgcauuaaaaguaguaagcguggaagacaguggcgaacgaaaaggaaaagauaucugguauaauguaacacuagaaaauggauggguauauaggagagcuucaaacauuccacuugauuggacaggaaaaguaaaagaauuuguugucacaaccgaauuagacgaugccggaaacccaaagaaagacaaagaaggaaauguaaaaagaaguuucagagcuccgaaagaagaugauuggggacuucuaaaaacacgaacacaagcacaaauugaugaaagcggaaaaaccgucggcacauauauuuacgaaagccuucuauguaugcccaaucagaaaaucagaggaaaauuagucagaacuauugaacgcaaauacuacaaagacgaacuaagacaaauccuaguaaaacaaucagaauuucaugcugcgcuucaagaucauaacuuacuuuuaagcuguauugaagaacucuacccaaacaacgaagcucacagacgacuccuuuccgcuaguucauucauauauuucuuaauagaggauauucuauuuuaccaaagaccacuuaaaagucaaaaaggccuuauugauaacuguccauacgaaucccacauauacaaagauaagaaagacgggagccuccaccauguaccacuaaaaugcgugucaaaaucacacccguuauuccaagaguuuagauuauggcaauucuuaucaaauuuaagaaucuaccaaagagaacgaaugauggauggcucguuaaaauuggauguagacgucacuagagaauuucucccauccgaagaagacuauguaaaauuguucgacugguuaaacgagagaaaagaaauaagucaaaaauuccuauuagcauacaaacccuucggucuuaagaaaaacgaacaagcaaacuauagauggaauuauguagaagacaaaucguacccuugcaacgaaacuagagcagaaauaaaaucuagacucaguaaagcuggaguacccgaagaguuccuaacggaagaaaaagaagaagcguuauggcauauucucuauaguaucucagauaagaaagaacuaacaaaagccuugggaaccuucgcugcgaaaaauugucuaaaugaaucauucguagaagucuucgccaaaauaccaccauuugaaucgaacuacgcagcuuauagcuuaaaagcaauaagaaaauuacucgcauuaaugaggauggguaaauauuggaacgaacaagcaauugaccgucaaacuagagaccguauugagaaaauacucacaggcgaauacgaugaaacuauaagauccagagucagagaaaaagccaugcuccugacagacauaagcucauucagaggacucccuuuaugguuagcaugcuacauaguauaugauagacacucggaaucaaaagaacuuguaaaaugggaaacaccagcagauaucgaccacuuucuaaguaaauucaaacaaaauucgcuaaggaaccccaucguagaacaaguaauuacagaaucauuacguacgguccgagacauuuggaaacaagaaggaaaaauugaugaaauacauguugaacucggacgagaaaugaaaaacccagcaaaagaaagagcacgaauuacagcucaaguacaagaaaacgaaaauacaaaccuacgaauaaaggcuuugcucgcugaauuuaugaauccugaguucgaaaucgaaaacguucaucccuauagccccggucaacaggaaauucuacguauuuacgaagauggaguucuaucgggaauagcagaaaaagaccuaccagacgacauuacugcaauacuuaagaaauuuagagagaaugauguuaagaaaagaccaacuacaucggaaguauuacgcuacaaauuaugguuagaacagagauacagaagcccauacacagguagagucauaccauuaggaaaacucuuuacacccgcauaugaaauagaacaugucauaccccaaucaagauauuuugaugauucuauaucaaauaagguaauaugugaaagugccguuaacaaacucaaagacaacugccuaggauaugaguucauuaagaaacauucaggugagaugguugaacugggaaacggugaaaccguuccaguuuucucaguugaagaauacgaaagauuuguuaaagagucauauuucgguaauagcaagaaaaugaagaaacuucuccuagaggacauacccgacagcuucaucgaaagacaacucaaugauagcagauacaucucucgagucguuacuucauuacuuaguaaccuagucugugaagagggagaacaagacggucugaguaaaaauguaauaguguguacgggagguauuacugaucggcucaagaaagauugggguguacaagaaguauggaaucgaauaauauuaccuagauuccucagacugaacgagauaacaggcaggacagauuucacgucaacaaguguuaacggucacuuacucccugcacucccauuauaucuccaaaagggauucaacaaaaagagaauagaucaccgacaucacgcuauggacgcuauaguaauagcuugcgccaacagaaauauaguaaacuaucucaacaauucuucggcucggaaaaauucugaaauuucccguuacgauuuacaaagauuacuaugugaaaaggugaaaacagaugccaauggaaauuauaaauggauccuucgaaaaccuugggaaacauuuacgcaagaugucuacgcugcucuaacuaacauagugguaaguuuuaaacaaaaccuaagagugauaaacagaacuacgaauuauuaucaacauuacaacgaagcgggugagaaaagaaugauaccacaaacuaaaggcgauagaugggccaucagaaaaccaaugcauaaggauacaguauauggugaaguaaacuuaagaaaagagaaaacucuaccccuacgugacguagucaaaaaucccagcauuguaguagacaaaagccucaaaaauaaauuauaugaacuucugaaaagucaauacgaucuuaaagcgauagcaaaguacuuugaaacccaucaagauguaugggccgacguaaaucucaagaaaauuaaaguuuacuauuucacaaaagaaaccaacgaaagguucuuugcaacgcgcaaaaguuuagauccaaguuuugaucagaagaaaaucgaagaagaagucacagauacaggcguucagaaaaucuuacuacaucaccuucaacaaaauaacaaugacccugauauggcauuuaguccugacggaauagauaggaugaaucagaauaugacaauauuaaaugacggaaaauggcaccaaccuaucuacaaaguaaggacuuacgaaaaagccgacaaauuugcggucggggaaaguggaaauaaagcaaagaaauuuguagaagccgcgaaaggaacuaacuuguucuuugcuguuuaugaaagcguccaagaagaugaagcaauugguaaacaaguuugcaaaagaacauucgcuacuaucccccuaaaugaaguaauaaaacguaagaaacaaggacucccugccgcccccgaagauuuaaaugguaacuuaccaaaauuuguucuaucacccaaugaucuuguauaucuaccaacggaggaagaaagaaauagcucacgaauaauccagccauuagacagagaaagaauuuauaaaaugguaaguucaucaggaucucagugcuucuuuaucaaaguauucguugcaaauucaaucugggacaaaaacgaauauaguuccuuaaacaaaauggaacgugcgauaacaaacgaaaugaucaaagaaaucugcguaccuaucaaaauagacagguugggaaauguuagcuuaauacaaauuuga

SEQ ID NO: 9229 - RNA, 4533 nt, Artificial Sequence
  Cas9 variant
augaaaagaauccuaggacucgaucuaggcacaaauucgauuggaugggcccuaguagacucagaagaacaaagaauauugggaauggguagcagaauaauacccauggaucaagguguauuggauacauucucggguggcaaccccguagaaacccaaacagccgcuagaacaguuuauagagggaccagaagacuucgagaaagggcucuacuaagaagagaacgauuaauacgagugcuaaacaugaugaaauuccuaccagaacacuaugcuucccaaauagacuucgaaaaacgauugggucaauucuuugacgaaaaagaaccgaaauuagcauggaaacaaaacgacgaaggaagguuugaguucauauuccaacaaucguucaacgaaaugauugaagaguucaaaaauaaagggguaguaagggaagauaagaaaauacccuaugauuggacaauauacuaccuaagaaagaaagcauugucucaagaaauagaaaaagaagaacuagcauggauccuuuugaauuucaaccagaaaagaggauacuaccaacuuagaggugaagaagaagaagaaaauccaaauaaauuaguagaauacuauucacuaaaaauaguagacguuauugcagacgaaaaacccaacucaaaaagcgacauaugguauucacuacaccuagaaaacggauggauuuauagaagaucaaguaaaauuccgcuauuugguuggaaagacaaaacacgagauuuuauaguaacaacagauuuaaaugacgauggaacggucaagaaagacaaagaaggcauugaaaaacggaguuucagggcacccagcgaaaacgacuggguauugcucaagaagaaaacagaaucggacauagaaaaaucacauaaaacaguaggcgcauacguguaugaaaccuuacuacaaaauccgaugcaaaaaguaagaggaaaacucguuaggaccaucgaacgcaaauucuauaaagaugaacuaaaacaaauacuggaaaaacaacgagaauuucauccagaacuacgagacgaagaccuauauaaugacugcguaagagaacuauauaggucaaaugaaacauaccaauuuauacuuucuaaaagagacuucgugcaccuuuuucucgacgacauuuuauuuuaccaaagaccacuacggagucaaaaauccgcuauaggggauugcauucuugaguucaagaccuacaaagauaaagacggaaauaauauuaaagaauauuuaaaaguaaucaguaaaucaaauccccuauaccaagaauuucgcaucuggcaauggcucuauaaccuaaaaauauacagaaaagaagacgacgaagacguuacgcuucaauucauagcaaacauagaagacaaagaacaacucuuugacuuuuuaagcaacagaaaaaguauagaacaaaaaccacuacuagaauaucuuauaaaagccaaagguuuaaagaaacagguuaaaacggaagcauaccguuggaauuacgucgaagacaaaauauaccccugcagcgaaacaaaaacgaugauaaguacucgacucgcaaaaguugaaaacaucccagauaacuucuucacaaaagagaucgaacaaaaacuauggcacauaauauacaguguaaccgacaaaaaugaguucgaaaaagcacuacgaacauucgccaagaaauacgaccuagauauagcaucuuucguagauaauuucaagaaaauaccacccuucaaaaacgaauaugguagcuuuagcgaaaaagcaauaaagaaacugcuaccacuaaugcgauugggaaaauacuggaaauggaacgacaucgacaauaacacucaaaacagaauaucgaaaauaauuacaggagaauacgacgaagaaaucaaagacauagucagagagaaaucaaucgcucuaacaaacgaaaaugacuuucaaggauugcaacuuugguuagcacaauaucuuguauaugggagacauucagaggcagauaucgcaggaaaauggcauuccguagccgaccuagaaaaguaucuaaaugaauuuaaacaacauagucuccgaaaccccauaguugaacaaauaauaacagaaacauuaagagucguccgggacaucuggcguaaauaugggcaaggagcugaaaacuucuucucagaaauccauguagaacugggcagagacaugaaaaauacagcagacgaaaggaagaaaauaguaaacgucguaaccgagaaugaaaauacaaauuuaagaauaaaagcacugcuaauggaacugaaaaauaacucagauggaaaacucgaaguagaaaauguaaggccauauucgcccacgcaacaagacauacucaaaauauacgaagaauaugcaauaaguacaggacuagauaaugaaaaagacgaaaaaguaaaagaggacaucaagaaaauaucccgcguggcacaaccaacaacaacagaacuucaaagauacaaacuuuggcuagaacagaaauauugcagcccauacacggguaaaguuauaccauuagguaaacuguuuaccgaagaauaucaaauagaacacauaaucccuaaaagucgauacuacgaugauagcuuuuccaacaagguaauuugcgaagcagcagugaauaaacucaaagacaaaugccuaggacuugaguuuaucaaaaacuaccacggacaaauaguagagaccggcuucgggcaaaaggucacgauauuugacgaagaggcuuaucaaaacuuuguaaaacaacauuaugcauauaaccacuccaaaaggacaaaauuacuauuagaggaaauaccggagaaaaugauagaacgacaaaugaaugacacaagauacauaucaaaauuuguacuaccacuacuuagcaaucuuguacgagcaaaagagaacgacaacgguguaaacagcaaaaacguacuaccagucaauggaaaaaucacaacaauguugaagcaagauuggggacuaaacgauguguggaaugacuuaauacuuccuagauucguaagaaugaacgaacuugcuaaaacaauagcauucacaagcuggaacgaacaacaucaaaaauaucuaccaacaguaccgcuagaacugucaaaaggguuccagaagaaaagaauagaucacagacaccaugcaauggaugcauuaguaaucgccugcgcuacaagagaccacguuaaccugcuaaacaacaaacacgcaaacacugacacgauaagauacgaccuccaaagaaaauuacgucuuuuugaaagagugacauacauagauccacagaccaaaaacaauguaaccaaagacauacccaaagaauuuaaaaagccaugggauaauuuuacaguagaugcaagaaaugaacuugagaaaaucauaguguccuucaaacagaauuuacgaaucauaaauaaagcaacaaacauuuauacaaaauacgaaaauggcaagaaaauaaaagucggacaaaaaggcuuaaauugggcuauccguaaaccucuacauaaggaaacugucuuugcgaaagugucauuaagaaaaaggaaaaccguucgacuuagcgaggcuuuaaaagacuggaagaaaauuguagacaagaaauuaaaacaagaaauaaaaagacugacgugucaauauggcaaguuugauguggacacaauacuucgcuacuucaaagauagaaaauaucaauucggggaagucgacguuuccaaaguaaagauguauuauuuugacgaagagaaugcagcaguaagaaagaacguagacacgaguuucaccgaaaaauucauacaaggaucaguuacagacacaggaauacagaaaauauuauuaaaucaccuagaagcaaaaggaaauaaaguagaaauagcauucagcccagaagggauagaggaaaugaacaaaaauauaauacaacucaaugaaggaaaacuucaccuccccauuuuuaaaguaagaguuuaugagacaauuggcaauaaauucaguguaggagugaaaggaaauaagaaagacaaauaugucgaagcugccaaagguacuaauuuauucuuugcaauauacguagacgaaaacggaauuagaucauacgaaaccauaccacuaaacauaguuauagaaagauugaaacagggacucucuguaguaccagagaaaaaccggaaggagcauaguuuauuauuuuauuuaagcccuaaugaucuugucuauguaccuauagaagaugaacgagagaacauacaugcagugaaccuugaucaacuuaauaacgaacaacgaaaacgaaucuauaaaaugguaaguugcacaggaagcgaaugucacuucguaccguacuacgucgccucuccaauuguaaacaaaguagaauacagcagcuuaaacaaaauaggaaggucauuaacuggagaaaugauaaaagacguauguaucaaacuaaaaguagaucgacucggcaacauaaaaggaauaucagggcucuga

SEQ ID NO: 9230 - RNA, 4533 nt, Artificial Sequence
  Cas9 variant
augaaacggauuuugggucuagaccuuggcacaaacucaauaggaugggcauuaguagacagcgaagaacaaagaauauuaggcaugggaucucgaauaauuccaauggaccaaggaguucuagacacauuuucgggaggaaauccuguagaaacacaaacagcagccagaaccgcauacagaggcacacgaagauuaagagaacgugcccuguuaagacgagaaagauugauaagagugcuaaauaugaugaaauuucuaccagaacacuaugcuagccaaauagacuuugaaaaacgacuaggccaauucuuugaugaaaaagaaccuaaacuugcauggaaacaaaacgacgaaggucgauucgaauuuaucuuucaacagaguuuuaacgaaaugaucgaagaguucaaaaacaaaggaguaguuagggaagauaagaaaauaccauacgacuggacaauauacuaccuaaggaagaaagcccugucgcaagaaauagaaaaagaagaauuagcauggauccugcugaauuuuaaucagaaaagaggauacuaucaguuacgaggagaagaagaagaagaaaacccgaauaagcuaguagaauacuacucauuaaaaauuguagauguaauagcggacgaaaaaccaaacucgaaaggagacaucugguauucuuuacaccuagaaaacggauggaucuaucgaaggaguuccaaaauaccacuguuuggcuggaaagauaaaacucgagacuucauaguaacaacggaucuaaacgacgaugguaccguaaagaaagauaaagaagguauagagaaaagauccuuuagagcuccuucagaaaaugacuggguacuucucaaaaagaaaacugaaucagauauagaaaaaucccacaaaacgguaggagcauacguauacgaaacauugcuacaaaacccaaugcaaaaaguaagaggcaaacuuguaagaacgauagaacgcaaauucuauaaagaugaacuaaaacaaauauuagaaaaacagcgcgaguuccacccagaauuaagggacgaagauuuauacaacgacuguguaagggaauuauauagaaguaacgaaacauaccaauucauauuaucaaaaagagacuuuguacaccuauuccucgacgauaucuuauucuaccaaagaccacuacguucucaaaagucugccauaggcgacuguauccuggaauuuaaaacauacaaggacaaagacggaaauaacauaaaagaauaucucaaaguaauuuccaaaagcaacccacucuaccaagaauuucgaauuuggcaauggcuauacaaccuuaagauauauagaaaagaagaugaugaagacguaacauuacaauucauagcaaacauagaagacaaagaacaauuauucgacuucuuaucaaauagaaagucgauagaacaaaagccacugcuagaauaucuuauuaaagcaaaagggcucaagaaacaagugaaaacagaagcauacagauggaacuacguugaagauaaaaucuauccauguucagaaacaaaaacaaugaucucuaccagacuugcaaaaguugaaaauauaccagauaauuucuucacaaaagaaauagaacagaaacuuuggcacauaaucuacaguguuacugacaaaaacgaguucgaaaaggcuuuaagaacauucgcgaagaaauacgaccuugacauagccucuuucguugauaauuuuaagaaaauacccccauuuaaaaaugaauacggaaguuucagcgagaaagcaauaaagaaauuacuaccccuaaugcgauuaggaaaauacuggaaauggaacgauauugacaauaacacucaaaaccgaaucagcaaaauaauuacaggggaauacgaugaagaaaucaaagacauuguacgcgaaaaaucuaucgcccucacaaaugaaaacgauuuccaaggacuacaacucugguuggcccaguauuuaguauaugggagacacucugaagcugacauagcagguaaauggcauucaguggccgaccuagaaaaauaccuuaacgaguucaaacaacacagucuaagaaauccaaucgucgaacaaauaaucacagaaacacuacgagucguaagagauauauggagaaaauaugggcaaggugcagagaauuucuucagugagauacauguggaguugggacgagacaugaaaaacacagcagacgaaagaaagaaaauagucaacguaguuacagagaaugaaaacacaaaccuacguauaaaagcacuucuaauggaacucaaaaauaauucagauggaaaacucgagguagaaaacguaagaccauauagcccaacucaacaagauauacuaaaaauauaugaagaauaugcaauaucaaccggacuugauaacgaaaaagaugaaaaaguaaaagaggacauuaaaaagauauccagaguugcacaacccacaaccaccgaacuacaaagauacaaauugugguuggaacaaaaauacugcaguccguauacaggaaaagucaucccacuaggaaaacuauuuacagaagaauaccaaauugagcacaucauacccaaaagcagauauuaugaugauaguuucuccaauaaggucauaugugaagcagccguaaacaaauuaaaagauaagugccuuggccucgaguucaucaaaaacuaccacggccagauuguagaaacaggguucggccaaaaagucacaauauucgaugaggaggcuuaccaaaacuuuguaaaacaacauuaugcauacaaccguucaaaaaggacuaaacuacugcuggaagaaauaccagagaaaaugauugagagacaaaugaaugacacaagauacaucaguaaguuuguacuaccacuacugaguaaucuuguacgagcagaagaaaaugacaacgguguaaacagcaaaaacgucuuaccagucaacggaaaaauaacaacaaugcuaaaacaggacuggggacuuaacgauguuuggaaugaucugauacuacccagguuuguuagaaugaacgaauuagcgaaaacaauagcuuuuacaagcuggaaugaacagcaccaaaaauacuuaccuaccguuccguuagagcuaucaaaaggauuucaaaagaaacguauagaccacagacaucacgcaauggaugcacucguaauagcaugcgcaacucgcgaucacguaaaccuacuuaauaauaaacaugcgaauacagauacaauacgcuacgaccuucaaagaaaacuuagauuauucgaaagagugacauacauagauccccagaccaaaaauaacgugacaaaagauauaccgaaagaguucaagaaaccuugggauaauuuuacaguagacgcgagaaaugagcuugaaaagauuauuguauccuucaagcagaaucuuagaauaauaaauaaggcaacaaauauauauacgaaauacgaaaaugguaagaaaauuaaaguaggccagaaagguuuaaacugggccauacgaaaaccacuacacaaagaaacagucuuugcaaaagucagccugagaaaacgaaaaacaguacgccuuuccgaagcacuaaaagacuggaagaaaauaguagacaagaaacuuaaacaagagauaaaaagauuaacaugucaauacgguaaauucgauguagacaccauauugcgauacuuuaaggaccgaaaauaccaauucggcgaaguagacguuucuaaaguaaaaauguacuauuuugaugaagaaaaugccgcagucaggaaaaacguagacacaucauuuacagaaaaguucauacagggauccguaacagauaccggaauacagaaaauuuuacucaaucauuuagaagcuaaaggcaauaaagucgaaaucgccuuuagcccagaaggcaucgaagaaaugaacaaaaacauaauccagcuaaaugaaggaaaguuacaucugccgauauuuaaaguccgaguauaugaaacgaucggaaacaaguuuagugucgguguaaaagguaacaagaaagacaaauacguagaagcagcgaaaggaaccaacuuguucuucgcaauauauguugaugaaaauggaauaagaagcuaugaaaccaucccacucaauauaguuauagagagacuaaaacaaggucuuucaguaguuccagagaagaacagaaaagaacacucauuacuauucuaccuaagcccuaaugacuuaguauacgucccaauugaagaugaaagagaaaauauucacgcagucaaccuagaucaauuaaauaacgaacaacguaaaaggauuuacaaaauggucuccuguacaggaucugaaugccauuuuguaccguauuacgucgcuucacccauaguuaauaaaguggaauacaguucccuaaauaaaauaggacgaagucuaaccggggaaaugaucaaagacguuugcaucaaacuaaaaguagacagauuagguaauguaaaagguauuucuggucuauga

SEQ ID NO: 9231 - RNA, 4536 nt, Artificial Sequence
  Cas9 variant
augaaaaaaauccuggguuuagaucuuggaacgaacucuauaggcugggccgugauaaacucaguugcggacgagagcguagaaaaacgaaacauagaacuagcagguucccggauaaucccaauggacgcagcaguacuaggcaauuucgacaauggugucacaaaaucccaaaccgccgaaagaacaucuuaccggaguauaaggagauuaagagaacgacaauuacuaaggagagaaagauuacauaaaguacuacaaauacuagguuuucucccagaacauuacguaaacgauauagauuuugaaaaccacccuggaaaaauaaaaaaaaacaccgaaccuaaauuacccuggagaaaaaauaguaugggacaauucgaauucauuuuccaagcuuccuucgaagcaaugcuaacagacuuugcaacucaucagccaguuuuuguaagugaagguaaaaagguacauuacgauuggacacuauauuauuuacgcaaaaaagcauuaacggaagaaauuaguaaagaagaacuugccuggaucauacucaauuuuaaucagaaaagaggauauuaucaauugcgaggagaagaggaagaagagcagaguaauaaacuaguagaauucuaugcucuacgaguaguuaaaguugaagcuacagaugauaaaaaaggaaaagacacaugguacaauguccauuuagaaaauggauggauauaucgccgaacuucaaacauuccccuugacugggaggguaaaguaaaagaauucauaguuacaacagaucucaaugaagacggaacuccaaaacuugauaaauacggagaaguaaaaagaucauucagagcgccaaaggaagaugacuggacauuaauaaagaaaaagaccgagagcgacauagccaauagucacaaaacccuaggcuguuauauuuaugacgcacuccuucaaaaccccaaucaaaaaauaaaaggaagauuaguucgaacaguagaacgaaaguuuuacaaagaagaacucagauugaucuuagaaaaacaauuaaguuuccaucccgaacuacaagaucgagaccuauacagggcguguauagaugcuuuauacguaucaaacgaagcccauaaaaacaauauuaguggaagagauuucguguacuuauuuauagaugacauaauauuuuaccaaagaccuuugaaaaccaaaaaaucauuaauagacaacugccccuaugagaaaaaccaauacauggauagagaaacaggugaaguuaagcaagcaccaauaaaaugcauugcaaaaagccaccccuuauuucaagaauucagacuauggcaauuuauaagcaacauaagaauauaccagagggaacgcgugauggacgaugggaaacuugaaacagauguagacguaacaccugacuuuuuaaagacagaagaugacuacaccacacuauucgaguggcuaaaugauagaaaagaaguggaucaaaaagccuuucuaaaaaauccacaauucggacugaagaaaacuuucacagaguaucgauggaauuauguggaagacaaaucauacccaugcaacgaaacgcggaaugcuauacugaauggguuacaaaaggcuggugucagugcggacuucuuaucacgcgaggucgaagaagcacuauggcacauccuauacagcguagaagauaaaaucgaaaucgaaucagcacuacguaaauuugcaaguaaacacgaccuagacgauagguuugcggauguauucaaaaaacucccccccuucagaaaggaauacggagccuauagugccaaagcaauaaaaaaacuuuuaccuuuaaugagaaugggaaaauacugggaacuaagcaacaucgacgacaaaacaaaagaaagaauagauaaaauaauaaccggugaaugggaugaaaauauacacaaccgaguacgagaaaaagcaauuaaacuaucagauauaacagacuucaagggauuaccauuaugguuaucgugcuauguggucuacaaucgacacagcgaagcacgggccauagcuaaaugggaaucccccgaagacauagacucauaccuacgauuguucagacaacauagucuccggaacccugucgucgaacaaguaauuacagaaacucuacgcaccguaagagacaucuggaaacgaauaggccaaaucgacgaaauacaugucgaauuaggaagagagauaaaaaauccagcagacaaaagagcuaaaaugacagcucaaaucguagaaaacgaaaacacaaaccuaagaauuaaagcacuacuagcggaauuuauaaacucagaauaugaaauagaaaacguaagaccauauagcccgggacagcaagaaauccuaagaauauaugaagacacaguuuuaaacagcgucgaagaaauaccagaagauauaagcgcagucuuaaaaaaauuccgugaauccgaucuaaagaaaagaccuacaaaaagugaguuucuucgcuacaaacuaugguuagaacaaaaauacagaucaccauauacuggugacaucaucccauuggguaaauuauuuacaagcgcauacgagauagaacacauaaucccacaaucaagguacuuugacgacuccuucucaaauaaaguaauaugugaagcagagguaaauaaauugaaaucaaaugaacuuggauacgaguucauaaaaaaucaucacggacaauacguagaaauaggauucggaaaaguagugcaaauauuuucaauagaagcuuacgaaaaauuuguaaaagcgaacuacuccggaauuggaaguaaaaugaaaagauuacuaauggaugauauaccugaaaccuucauugaaagacaauuaaacgauucgagauacauaucaaaaguaguaaaaagucucuuaagcaauauaguucgagaaaaagauucaaauggugaauaugaaccagaagcaauaagcaaaaauguaauaguauguacaggaagugucacagaccgccuaaaaagagacuggggaguaaaugacguauggaacucgaucauauacccuagguuugaacgcuuaaaugaacuaacugguucccagcaguuuggauguugggaaaauaaagaaggcaaaagagucuuccaaacagcaguaccauuggaaaugcaaaagggguuuucaaaaaaaagaauagaccacagacaccaugcaauggacgcgauaguuauugcaugcgcuauucgaaaucacauaaauuauuuaagcaacgaauccgcuucuaagaaagcgaaaauauccagaauagacuuacagagauuauuauguacaaaaugccgaacagaugacaauggaaauuacaaauggauaguuaaaaaaccguggcccgccuuuacucaagauauaagaaaagcucucgagaacaucacgguauccuuuaaacaaaacuuaagaguaauuaacaaaacuacuaauuacuacguacauuuugacgaaagcggaaaaaaaguacuagaaaaacaaaucaauggagauagcugggcaauacgcaaaccaaugcauaaagacacaguauuuggaaaaguaaacuuacaaaaagugaaagaaguuagauuauccuuagcauuagauacacccaagaugaucguagacaaaaagcuaaaagaaaaaguguuacaauuauacagcuauaaguacgacaaaaaaagaaucgacaaauauuuuaaagagaacgcaagccuuuggaaagaccucaauuuaagcaaaguagcaguguacuacuucacaaacgacagcaccgaaccacuaguagcaguaagaaagccucuagacacaucguucaaugccaagaagauaaaggaaucuguuacagacaccggaauucaaaaaauacuuuugaaucaucuaagcaacaaccaagauaaucccaaccuagcauuuagcccagacggaauugacgaaaugaaucgaaauuuaacuacacucaaugauggaaaauaccaccagccgauauauaaagucagaguuugcgaaccacaagguaauaaauucuccguggguacuaguggcaauaagaccaguaaauauguugaagcagcuaaaggcacaaacuuguuuuuugcagucuaucaaacagaagacgggaaacgaaauuacgaaacuauacccuugaacgugguaauagaacgggagaaauuggaaugggccccugugccugaaaauaacaauaauggugacaaacuacuauucuggcuaagcccuaacgaucucguauacgugccgacggcagaugaauugaacaacggaaugagacuggauaacauggauaagggacguaucuacaaaaugauauccugcucagguccucaauguuuuuuuauuccacaaaaugugucaaaucccaucauuccaguuauagaacuggggguaaauaacaaagcagaaaaaagcuggaauaacgaaaugauaaagguaguaugcguacccauacgaguagaucgcuuaggcuguauaacacaaauaaauaaccaaaaauga

SEQ ID NO: 9232 - RNA, 4539 nt, Artificial Sequence
  Cas9 variant
augaaaaagauauuaggccuugaucuaggaacaaauaguauuggaugggcuuuaaucgaaaacuccuuuacugaaaaagaaggaaaaauaaaugacaugggcguuagaauaauacccaugucugccgauaucuuaggcaaauuugacgcgggccaaagucauucgcaaaccgccgaacgaacaggauaccguggaacgaggagguuauaucaacgagacaaucucagacgagaaagacuacaccgaguucuacauauacuaggcuuccuaccgaaacauuaugaugaacauauagauuuugagaaaagacuaggacaauucaaagaaggcaaagaaauuaaauugaauuacagguguaauguugaaaacaaacacgaguucauuuuuauaagcucauucaacgaaaugcuaacagaauuuaagaaagcccagccggaacucuucuaccuuaaauccaacggagaagaaacaaaaauaccauacgauuggacacucuacuaucuacgaaagaaagcguuaucacaaccacuuaccaaacaagaacuagcauggauaauacugaacuucaaccaaaaacgaggauauuaccaauuacggggagaagaaaucgaugaugacaaaaauaaacaauuuguuaaacuaaaaguuaaagaaguaaucaacagcggagaagccguaaaaggaaaaccauuauuugacguaauuuucgaaaacgguuggaaauaugauaaacaaguggugaaaacagaagauuggauagacagaacuaaagaauuuauagucacaacaaaggucuugaaaaauggagaccuaaaaaggucauauaaaacgguagacucggagaaagacugggcagcaauuaaagcaaaaacagaacaagauauagaaagaagcaacaaaacaguuggagaguucaucuaugaaacucuauuagaaaacccaacccagaaaauaagaggaaagcuaguaaaaacaauagaaagaaaauuuuacaaagaggaacugaaaaauauacuaauaaaacaaauagaauuacaacccacacuauucagcgaagaacuauauaaagccuguauugaagaauuguacccaagaaaugaagcacaucaaaacgccaucaaaaaucgcgauuucauauauuuauuaauggacgacaucauuuucuaucaacgaccguuaaaaucgcagaaaagcaacaucagcggcugucaacuggaacaaaggguauauuacaaagcaaauaaagacagcggagaaaaugaagaagucaaacaagccgucaaagccaucccaaaaucgcacccguuauuucaagaauuucguaauuggcaaugguuacagaaccuaaaaaucuacaacaaaguugacaccgagaaaggagaacucacugacguaacaaaacaauuacuaccaagugaagacaguuggguaaaucuauuuaauuuucuucaaugcaagaaagaacuagaacagaaacaauucauaaaauacuuuaucgauaagaaauuaauaaacaaaacagaaaaagaccauuaccgauggaauuaugucgaagauaagaaauauccuuuuacagaaacccgagcgcaguucaucucacgccucacuaaagucgaaggaauagaagaaauaaauaccuuccuagauaagaaaacacaaauagguacaaaagauaauuccccauucguuuccagaaucgagcagcuauggcacaucaucuauucaguaagcgacauuaaagaauacgaaucugccuuagaaaaauucgcuauaaaacaucacuuaaacgaagaaucuuuuguagcaaacuucauaaaguucccaccauuuaaaucagauuacggaucauacucuaagaaagcucuaaauaaacugcuuccucuaaugagaagaggcaacuauuggacagaaaaugacaucuccgaaaaaguaaaacuacgcguuucagaaauaauggagagaguaaacgcccuaaacuuaaaagaagacuauagcagcaaagaacuugcagaaacacucgugaauguaucagacgacgacguaaagaaacaacuaauaaaaucauucguaucuuuuaaagaucgcaauccgcucaugggauuaaauaccuuccaagcaacuuaccucguuuacggaagacauucagaaguaggagauauacaaaacuggaaaacgccagacgauauugacacauauuuaaagaauuuuaaacaacacucccuccggaaucccaucgucgaacaaguagugacagagacauuaagaguaguucgggacauauggaagcaucauggcaaaucucaaacaaacuucuuuaaugaaauacaugucgaguuaggacgugaaaugaaaaauccugcagacaaaagaaaacgcauaucugaacgaaacaccgaaaaugaaaacacuaacaaucgaauaagagaaauccuuaaagaucuaaugaacgacgcuaguauucaaggagacguacgagacuauucgcccagccagcaagguauacucaaaaucuaugaagagggaguauaucaaaacccaaaaguggauuacucgaaaguguccgaagacgaaauaacaaaaauucgaagaucaaacaacccuacccaaaaagaaauacaacgauacagacucuggcucgaacaaggauacauaagucccuauacuugcaaacccauaccgcucucgaaacuuuucacccaccauuaucaaaucgaacauaucauaccucaaaguagauacuucgacaacuccaguaguaauaaaaucauaugugaaagcgaggucaacgaagacaaagacaacaaaacagcauucgaauaccucaaagacaaaggagaaaacgucauaaacggccacaaauuauuaucuuuagcggcauaugaagcacacguaaacaaauacuucaaaaacaauagacaaaaacucaaaaaucuauuaagcgaagauauacccgagggauuuauaaacagacaaaugaaugacucaagauauauauccaagcuaguaaaaggacuccuuucaaacauaguaagggaagaaggcgaacaagaagucacaagcaaaaaucuaauuccggucacuggcucaguaacaucaaaguugaaaaacgacugggguuuaaacgauaaauggaaugaacuaauacuaccacgcuuuaaaagacuaaaucaacucacacaaaccaacgacuuuaccacagccaacacaaacggaaauaccauaccaaccguaccggacgagcuacucaaggguuucagcaagaaaagaaucgaucauagacaccacgcucuagaugcauuggugguagcauguugcacaagaaaccauagcaacuacuuaucagcacuaaacacagaaaacaaaaacuacggcuuaagagauaaacuauuaaucaaaaacgacaaugaucauuauacuaaaucauuucaaaugccauggcauggauuuacaacagaagcgaaaaaccaacuagaagaaacgguaauaucauuuaaacaaaaccuaagaguaauaaauaaagcaaacaauaaauucuggagcuauaaggaugaaaacggaaaguuaaaccuagauaaaaauggaaaaccuaucaaaaaguuaagaaagcaaacuaaaggagacaauugggcaguaagacaaccauuacacgaagaaacaauaucaggaauuguaaaucuaccauggguuaaagcagaaaaggagaaauucacauaugcaacacggaagucacucgauaagaguuucgaucucaagaaaauugagaaaauuacagacacuggaauccagaaaauccuacgaaauuacuuaaugcaagaaaaauuuaaagaauuagauaagaaagacaaagaaguauauaauucggaauuagcguucagucaagagggucucgaagacuuaaacucaaauauagagcaguucaaugaccaaaaaccacacaaacccauauauaaaguacgccuauucgaaaaaggaucaggucgauuugcacucgguuucaaaggaauuaaugcaaagaaauacgcccaaggcucaccuaaucuguauuuuaauaucuaccgaaaugaagauggacaauacuacgagacuguaccacucaacaaaguaaucauacaucagaaaaacgcugcaaacaugccuaaaaagaauagaacuccaguuccgauuucaaacacagcgauaaacagaagcaaagaaguacucguagacuacaagaugaccuuaucgccccuagaccuugucuacauuccgacugaagaagaacuaaacaauauaaauucacuagacuuuaacaacuuaucgaaaucucaaagaaaacgauuauacaauguaaaugacuuuagcggauacaccauauauuuuucaccaaauacacuugcaaaaucuauaugucccaaagagguagauaugaaauucgacgagaagaaacagaaaccaacaggaaguuucgacaguaaaacagccagccuagacggaaugucaaucaaagaaagaugcauaaaacuuauuauagaucgccucggcaacauaucaaaagcauga

SEQ ID NO: 9233 - RNA, 4539 nt, Artificial Sequence
  Cas9 variant
augaagaaaauacucggacuggaucuaggaacuaauaguauaggaugggcaguaguuaaugcagacgaaauuacaagagacgacggaagccgauauuuaaaaccaaacggaauaagcgcggcaggaucgagaauaauaccaaugagugcagacaucuuaggagauuucgaaaaaggaaacagcauaagccaaacagcagaaagaacacggaugagaauggcaagacgucuacaugaaagagcacuuuuaagaagagaaagacuauuacgaguacuaaaccuacuagauuuccuaccuaaacauuuugcagacaaaaucgacagauauggcaaauucacagacgauucagaaccaaaacuugcauggaggaaaaauacagaaggcaaauaugaauuuaucuuccaagacgcauuuaaugaaaugcuugcugaauuuaaagauaaacaaccagaaauuguggaagaagguaagaaaauaccauacgauuggaccauuuauuaucucagaaagaaagcauuagaaaaagcacucucaaaagaagaacuaagcuggauacuacuacaauucaaucagaaaagaggcuauuaucaauuaagaggcgaagaagaagaaaucccacaagacaagaaaauugaauaccuagcacaaaaaguagugaaaguagaagcaacugaucaaaagaaaggagacgauguuugguacaauguauaucuagaaaacggaaugauauaucgcagaacuucaaaagccccgcuggauugggaaggaaaagucaaagaauuuauaguaacaacagaaguggaaaacgacggcgaaacacccaagaaagauaaagaaggaaacauaaaaaggagcuucagagcucccaaagaagaugauuggaccuugcucaaaaagaaaacagaagcagacauagaaaacucacauaaaacagugggcugcuauauauacgacucauuacuaaauaauccuaaacagaaaauaauaggaaaguuaguaagaacaguagaaagaaaauuuuauaaagaagaacuaacacaaauucucaagaaacaaguugaauuaauaccggaacucagagacgacaaccuuuacaaacaaugcauagaggaacucuacccuauaaaugaagcacaucgaaauacaauugcuaaaacagacuuugcaaauuuauuuauaaacgacauauuauucuaccaacgcccacuaaaaucgaagaaaucacaaauagauaacugccccuaugaagaaagaauauuuaucgauuccaaaacaggggagaaaaagaaaguaccgguaaaauguauugccaaaaguaauccgcuuuuucaagaauuuagacucuggcaauuuauacaaaaccuuagaauauaucaaagagaaaaagagauagacggcaaacuucuaacugauauagauauaacauccgaaugccuuaaaagugaagaagacuacgugcgauuauuugauuggcugaaugaccgggaaacuaucgagcaggaagacuuguuaaaacaucuauucaacacaaagaaaagcaaaaauaaagaaaaccccuauagguggaacuauguggaagacaaagucuacccuugcaacgaaaccagagcaacuauccuuaaaggguucaguaaaugugggauaaaugccagcgugcuaaguccggaauuagaaauggcauuguggcauaucuuauauucaguggaagauaagaaagaaaucgaaacagcuuuaacacacuuugcccaaaaacaaggauggaaugaugacuucgcgaaaguauuuucaaaagccaaaccauucaagaaagacuacgguuccuacagugaaaaagcaaucaagaaauugcuuucacuaaugaggaugggaaaauacuggaaccaggacaauauugacaaaaauacauuagaccguauagauaaaauaauuaacggcgaauaugaugagaaaauuucaaaccgaguaagggacaacgcaauaaaccuaaaagauauaucagacuuucgaggacuaccaguauggcuagcguguuacauagucuacgacaggcauucagaagcuaaagauugcacgaaauggaauagcccugaagaaauugacagcuaucuaaagaaauuuaaacaacauucauuacgcaauccaauuguagaacaagugguaacugaaacguuacggacagucagagacauauggauucaagaagaacaaauugaugaaauacauuuagagcuaggccgugaucugaaaaacccggcugacaaacgaaagaaaaugucagaaaacauauugaaaaacgaaaacacaaaccuacguauuaaagcuaugcuaauggaguuuaugaauccuaguauggguauugaaaacguaagaccauacucaccaucacaacaagacauucuaagaauauacgaagaaaaugccuuagacaaucuaacgaaagacgauaaagacuucgauuucauaucaaaaauauccaaacaagcacaacccucuaaaacugacaucauaagauacaaauguuggcucgaacaaaaauauagaaguccauacacaggaaaaaccauaucguuaucaaaacuauucacucccgcauaugaaauagaacauguuaucccacaaucacuauacuucgacgauagcuucaguaacaaaguaauaugugaagccgaagucaacaaauuaaaagacagacaauuaggcuauaaguucauagcggaacaucacggcgagaaaguacaacugagucaaggagaaguaguagaaauacuaaguguugacgcauaugaaaaauucgugaaagaaaacuaugcaaauaaucgaauaaaaaugaagaaauuacuaauggaaagcauccccgacgaguucaucgaacgacaacuaaaugacagcagguacauaaguaaaguuguaaaaggucuuuuaaguaacauaguaagagagaaaauugacgacgaaaacuacgaaccugaagccgugaguaaaaaccuaauaucaugcaacggcgcgaucacggacagauuaaagaaagacuggggaaugaaugauguauggaacucuauuauucuaccgagauucauaagaaugaaucaaaucacagguaaagauugcuuuacaacuacuaacgcagaaggccauuuaaucccacaaaugccacucgaacugcaaaaaggauuuaauaagaaaagaauugaccaccgucaccacgcaauggaugcaaucguaaucgccuguaccaccagagaccacguaaaucuuuugaacaacgaagcggcacauagcaaauucaaugcgacaagauaucaauuacaaagaaaauuaagaagguuugaaaaagcaguaauagaugguaaagaaagggaaguagccaaagaguucuuaaaaccgugggacaguuucaguagcgacagcaaaaacauucuagagaacauaauaguaucauuuaaacaaaaccaacgaguaaucaauaaaacuacuaacgcuuucuuacauuuugacgagaacgguaagaaaacauucaucaaacagggaaaaggugacagcugggcaauaagaaaaucgaugcacaaagacaccguuuucggcgaaauaaaucugcgaaaagugcgcucugucagccucaaugaagcaaucaagguaccagaaagggugcugaacaagaaaauaaaagagaaaauauuagaacucaagaauaauaaaauugacgccaaaaauaucaagaaauacauugaagaaaaccacacuggaggauacgguauagacucuuccaaaaucgauguauuuuauuucaccaaagaaacuaaagaaagauucuucgcgacaaggaaaacacuugauacuucauuuaaccaagcaaaaauaaaggacaguaucgcagauuccgggauucagaaaauacuccucgcccaucuaaaaucgaaaaacggagaugcagaacaagcauucaguccagacggaauagaugagaugaacaaaaauauaguagaauuaaacaacgggaaguuccaucaaccaauacuuaaaguaagagucuaugaaaaagcagauaaauucgcagucggacaaaagggaaauaagaaaguuaaauucguagaagcagccaaagggacaaaccuauucuuugcaauauucgagaaagauggcaaaagaucauaccuuacuauaccacuaaauguaaugauagauugucaaaaacaauauggaaaucaauggaaaaauaauauagaggcuuaucucaaagaaaaggaguuaguagaaaaggaugugaaacuccaauucauucuaaguccuaacgaccuaguauauuuaccaacagaagguucaauagacaagaaacgaauuuacaaagucguuaguuuuaccaauaaccgauuauacgcgaucccauacgcaauagcuaaauccauaguugauaagaacgaauuuacucagcugaacaaaaucgaguucacagacaauaaagaaucaaucaaagacgcgugcguaccagucauaaucgauagacuagguaacguuauagaguucaauggcaaaagacucuga

SEQ ID NO: 9234 - RNA, 4539 nt, Artificial Sequence
  Cas9 variant
augaagaacauucuaggacucgaucuuggcacuaauuccaucgggugggcaguaaucaacagcgaggaagauggaccaaucguaaaaaagagaauugaauuagcgggaucgcgcauuaucccaauggacgcagcaguacuagggaauuucgacaguggaguaacuaagucacaaaccgcugaacgaaccagcuuuagaagcauuagacgccugcgagaaagacaauuauugcgaagagaacggcuucauaaagugcuacaaaucuuaggauuccucccugagcacuacguaaaugauaucgacuuugaaaaccacccaggaaaaauaaaaagaaacacagaaccgaaacucccauggagaaaaaauagcaugggacaauuugaauucaucuuccaagacucauuugaagcgaugcucacugauuucgcuacccaccaacccguauuuguaucugaagguaaaaaaguaccauaugauuggacacuguauuacuuacgaaaaaaagcucuaacagaagguaucucuaaagaagaacucgcuuggcugauauuaaacuucaaccaaaagagagguuauuaccaacuacguggugaagaagaagaggaacaaucaaauaaacucgucgaauuuuaugcuuuaagaguaguaaaaguugaagcuacagacgauaaaaaaggaaaagauacgugguacaacguucauuuagaaaauggauggauuuaucgaaggacaucaaauauaccuuuagacugggaaggaaagguaaaagaguuuauaguaacaacagaucuaaaugaagauggcacaccaaaguuagacaaauacggcgagguaaaacguuccuuuagagccccaaaagaagaugauuggacacucauaaaaaaaaaaacugaaucagacauagcuaauucccacaaaacagucggcugcuauauuuacgacgcguuacuucaaaacccacaucaaaaaauaaaaggaagacuaguacgaacuguagaaaggaaguuuuacaaagaagaacuacguuuaauuuuggaaaaacaacuaaguuuccacccugaacuacaggaucgagaccuauacagagcaugcauagacgcucuguacguuaguaaugaagcacauaagaauaacauaagcggucgagauuucguauacuuauuuauugaugauauaauauucuaucaacguccacuaaaaacuaaaaaauccuuaaucgauaacuguccauaugaagaaaaccaguacauggaucgagaaacaggagaagucaaacaagcaccaauuaaaugcauagcaaaaagccauccacucuuucaagaguucagacucuggcaauuuauaucaaacaucaggauauaccaaagagaaagagugcuugaugauggaaaauuagaaacagacguagacgucacuccugacuuucucaaaacagaagacgauuauaccaccuuauucgaaugguuuaaugaucgaaaggaagucgaucaaaaagcauuccuaaaaaauccucaauuuggacucaaaaaaacauucacagaauacagauggaauuacguagaagauaaaucauaccccuguaaugaaacaagaaacgcuauacuaaacggacuucaaaaggcaggaguuucugcagacuuucuaucaagagaaguugaggaagcucuauggcacauucuauauaguguugaagauaaaauagaaaucgaauccgcacuacggaaauuugcuucaaaacaugaccuagacgaucgauuugccgacguguucaagaaauuaccaccguucaaaaaagaauacggagcuuacagcgcaaaagcaaucaaaaaauuacuaccauuaaugagaauagguaaauauugggaacuuucgaauauagacgauaaaaccaaagaaagaauagacaaaauaauaacuggagaaugggaugaaaacauacacgacagggucagagaaaaggccaucaaacuaucagacauaacagacuuuaaaggauuaccauuaugguuaucauguuaugucguauacaauagacacucugaagcacgagccauagcaaaaugggagucucccgaagacaucgacagcuacuuacgcuuguuuagacaacacucuuuacguaauccaaucguagaacaaguaaucacggaaacuuugcgaacgguaagagauauauggaaacgcguggggcaaauagaugaaauacauguugaguuaggacgggaaauaaaaaacccagccgauaaacgugcaaaaaugacugcgcaaaucguugaaaaugagaauacaaauuuacgcauaaaagcuuuauuagccgaauucaucaauuccgaauaugaaauugaaaacguacgucccuauagcucaaaccaacaagaaaaacuaaagauauacgaagauacuguccucaaugguguaaaagaaauaccugaagauaucaacacgauauuaaaaaaguucagggaaagcgaucucaaaaaacguccaacaaaaagugauuuccugcauuacaaacuguggcucgaacaaaaauacugcucacccuacacaggacgaauaauaccuuuaggaaaacuuuuuacuucagcauacgaaaucgagcauauuauaccgcaagcacauuauuucgaugacucauuuucgaacaaagucauaugcgaagcagaaguaaacggguuaaaagauaaaaaacucggauacgaguucaucaagcauaacccaggaaaaaugguggaaauaggcuuuggaaaaccuccugugagaauauucucaguagaggaauacgaaagauuugucaaagaaaauuacucaggaauuaaaaauaaaaugaauaaacuauugauggaugacauaccagaaacguucaucgaaagacaauuaaacgacucaagauauauaucgaaaguuguuaaaaguuuacuaucaaauaucguacgcgaaaaagacucaaacggugaauacgaaccagaagcaauauccaaaaacguaaucguuuguaccggaucaguaacagauagacucaaaagagauuggggugucaaugacgucuggaauucaauaauuuauccacgcuucgaaagauuaaaugaacuaacaggcucacaacaauucggaugcugggaaaacaaagaggggaagcgaguguuccaaacugcaguaccccuugaaaugcaaaaaggauuuaguaagaaaagaaucgaccaucgacaucaugcuauggacgccauuguuauagcuugcgcaacacgaaaccacauaaauuaucuaucaaacgaaucggcgucuaaaaaagcaaaaauaucaagaacagauuuacaaaggcuacuauguacaaaaugcagaacagacgauaauggcaacuacaaauggauagucaaaaaacccuggccggcauuuacacaagauauaagaaaagcacuagaaaacaucacaguaucuuucaaacagaacuugagagucaucaauaaaacaacuaauuacuauguacacuuugaugaaucagguaaaaaaguuuuagaaaaacaaauaaacggugacagcugggcaauacgaaaaccaaugcacaaggacacagucuuuggcaaagucaaucuacaaaaagugaaagaaguaagacucagucucgcauuggacacaccaaaaaugauaguagauaaaaaauugaaagagaaaguacuacaacucuauucuuacaaguacgauaaaaaaaggauugauaaauauuuuaaagaaaaugcuucucuguggaaagaccugaaccuaaguaaaguagcaguauacuauuuuacgaacgacucaacugaaccauuggucgccgugagaaaaccacuugauacaagcuucaaugcaaaaaagauuaaagaaagcguuacugacacaggaauacaaaaaauucugcucaaucauuuaucuaacaaucaagacgacccaaaccuugcauuuaguccagauggaauagauaaaaugaacaaaaacuuaaccgcccuaaaugacgguaaauaucaccaaccuauuuacaaagucagaguaugugagccacagggaaauaaauuuucaguuggaacaucaggaaacaaaaccagcaaauauguagaggcagcaaaagguacgaacuuauucuuugcaguauaucaaacggaagaugguaaaagaucuuaugaaacaauuccacuuaacguaguaauagaaagggagaagcuaggcuggaccccaguuccggaaaacaacaacaauggcgauaaacuacuauuuugguuauccccaaaugauuuaguauauguaccaaccgcagacgaauuaaacaaugguaugagauuagacaacauggacaaagguagaaucuacaaaaugauuucauguagcgguccccaaugcuucuuuauaccccaaaauguaaguaaugcgauuauacccgugauagaauuaggagcuaauaauaaagcugaaaaaucuuggaauaaugaaaugaucaaaguuguaugcgugccaauuagaguagauaggcucggcugcauuacacaaaucaacaaccaaaaauga

SEQ ID NO: 9235 - RNA, 4551 nt, Artificial Sequence
  Cas9 variant
augaaaaacauauuagggcucgaccuaggaacuaacucuauaggauggaguguaauccaagaaaaacauaaugaaaauaaugaaugccaaaaauuaauauugggagcaggaucuagaauaauaccaauggacgcagcaguauuaggcgauuucgccaaaggcaauaccauuucacaaacaaaagaccgaacccaauauagaggaguaagacgucuaagagaaagaugccuacuacgcagagaaagacuauuccgcguacucgauauaaugggauucuuaccccaacauuuuaguaaugcuuuaacaagguaugguaaauuuaaagaugcagaugaagaaccaaaaauagcauggagaaaagacgaugaagggaaaaugcacuuucuauuugcugacuccuuuaacgaaaugauugaagaauuucgcucaguacaaccugaacuucuaaaacgcggaaugaaaguuccauacgacuggacccucuauuaccuuagaaagaaagcgaugagagaagcaguaacuccauucgaauuggcgugguuaauacuaucauuuaaucagaaaaggggcuacuaucaauuaagaggagaagaagaaggagaagccgauaauuccaaaucagaagaauaucuagcacaacgaguaguugauguaauagauacaggagagaagaaagguaaaaguacaugguucgauauuguacuggaaaauggaaugguguaucacagaccggcagaaauaaaaccagauuggauaggaaaaacaaaagaauuuauaguuacuacacaauuugauaaagacgguaacccgaagaaagacaaagaaggaaacguaaaaaugaguuucaggaugccaaaugaaaacgauuggaaucuucagaaaaagaaagcggaaaaagauauagacgaaagugggaugaccgugggagaauauaucuacaaugcccuauuacacaaccccaaacagaaaauaaaaggaaaauuaguaagagucguagaaagaaaauauuacaaaaacgaauuacagaaaauacuugaaucacagaaaagauuuauaccacaauuaagcgauagugcuuuauaugaaaaaugcauuaaagaacuauaucaaucaaacgaagcauacagaaacucaauaagcacaaggaaugacuucacauauuuauucguugauaacaucaucuucuaccaaaggccacuaaaaagcaagaaaucauugauagauaacuguccauacgaaucucuagcauauacaaaagacggagaagaacacaaagcaccuguaaaauguauagcaaaaucacacccacuuuaccaagaauuuagguuauggcaauucaucuccaacuugcgaauauaccaacgucaaaaacaagugggagacaaaguaaaacuagacguagaugucacagaugaauuucuuccaacagacgaucguagagaaaguuuguucgacuauuuaaacgacaaaacugaaauaaaacaagauguauuauuaaaagaguucuuuucaaugaagaaaccaaaagguaaagauucaguauacccauacagauggaacuacguugaagacaaaucauaucccuguaacguaacaagaggcaaaauacucgcaaaacuaaacagggccggaauauccgcggacuuucuaucaaguaauggaaaugaagaaagucuuuggcacauacuauacucaguggaagauaaaggugaauuacguaaagcacucgcaagauuugcugcuaaaaauggacuagacgaugccuucacagaagcauuggcagauauagaaccauacaagaaagaauauggagcuuacucggccaaagcgcuaaagaaauuacuaccgcuuaugagacuuggaaaauacuggaacuaugauaauaucgcuccagccacaaaagcgagaauaagcaaaauuauagacggcgaauaugacgaaaacaucagaaauagagucagagaaaaagcaaugucacucaacagcgcaucacaauuccaagggcuaccacuauggcuagcuugcuacauaguuuaugacagacacucugaaagagcagauagcggcagauggaguucaccagaagauauugauaaauaccuaucggauuucaaacaacauagccuucgaaauccgauuguagaacaaguuguuacagaaacuuuaagaacuguuagggacaucuggaaaagguacggcgaaauauccgaaauucaugucgaacuuggacgcgaaaugaaaaauccagcagacaaacguucaaaaaugaaccgacguaugcuagaaaaugaaaaugcgaacaugagagccaaauuacuccucacugaguucaugaacccagaguucggaauagaaaacguaagaagcuacagcccaagucaacaagaacucuuacguauuuaugaagauggcgcaauauccaaugcaggcagugaaauagacgaugaaauaucagauaucaugucaagauugagccaaguagacguuaagaaacaaccaaccgcaucagaaguaaaacgcuacauacucugguuagaacaaaacuacagaucacccuacacaggccaaaugauaccacuugcuaaacuuuucacgccagcauacgaaauugaacauguaauaccccaaucccguuacuuugacgauucauuuaguaauaaaguaauuugcgaagcugaaguaaacaaacugaaagaucguaugcuaggauacgaguucauuaaacaacacaaaggagagaaaguuucauuaagcaugggagggaccgucgaaauauuaucaccagaagaauacguaagacacgucgagagccaauacaaaaacaauaaagcaaaaaugagaaaacuauuaauggacgacauacccgacgaauuuaucaacagacaacugaacgacagccgauacauuuccaaacuaaucauaagucuacuaucaaauauaguucgagaagaaggugaagaagaagcaacuuccaaaaauguaaucucaugcaacggauccauaaccgacaggcugaagaaagauuggggcaucaacgauguguggaaccacauaauucuaccaagguuucggagacuuaacgaacuaacuggaaccgacaaguucacuacaucaaauaaagaagggcacgaaguaccugagaugccucuagaacuacaaaaaggcuuuaacaagaaacgaauugaccauagacaccaugccauggaugcuaucguaauagcauguauaacaagagaccacguaaaucucuuaaauaacgaagcagcaaugagcaaaaacaaugcaaaccgaauacaauuaaguaagaaacugcgacguuaugagucgguggaaauagaaaaggauggcauaagaaagcaaauuucaauggccaaggaguucaaaaagccuugggaaggauucacagcagacguagaacgaacauuacgugauaucgugguuucuuucaagcaaaaccuacgaguaauaaacaagaccacuaauuacuaucaacauuucaaagauggcaagaaaauauauucaccccaaucuaaaggagauucuugggccaucagaaagucaaugcauaaagaaaccguauucggcgaaauaaacaucaggcgaauaaaagaagugucacuuaaagaagccaugaaaaggauaaaggauauagcagacaaagaacuucgaucgaaaauaguagaauuaauggcacuacaauacaaugagaagaaaauuaagcaauacuucagugauaauaaagacgaaugguccgaugugaaccccaagaaaauuaaaauacauuauuucacaaaagaaaccaacgaacgauuuuucgcaacacgaaaacccuuagauacuucauucgacaagaagaaaauaaagacgcaaguagcugauaccgcgauccagaaaauauuguuaaaccaccuaucagcacauggagauaaagcagaaacagcauuuucaccggauggaauagacgagaugaauagaaacaucauugaacugaacgauggaaaauuccaccagccuauacugaaaguaagaauuuacgagaaagcagacaaauacgccguaggacaacaaggaaauaagaagaagaaauauguagaagcugccaaagguacaaaccuauucuucgcaauauacgcggaagagaaaauagaugagaaaaccggcgauaccgucauaacccgaacauacgacucaauaccuuuaaacguagucauagacagagaaaaacguggacucagcccaguaccagaaaacgaaaauggagcaaaaccaaaauaugugcucucccccaacgaucuugucuacguucccaacgaagaagagagggaaacgggaagaauaugcgaaccauuagauaaagagagaauauauaaaaugguaucaucuaacaaaaagcaggcuuucuuuauaaaaucagaaguagcaagcacuauaguggauaaauucgaguucagugcuuugaacaagcaagaaagagcgcucagcggagaaaugauuaaagaaauauguaucccaauaucuaucaacagaaucggagaaauaacuuugagauga

SEQ ID NO: 9236 - RNA, 4554 nt, Artificial Sequence
  Cas9 variant
augaaaaaaauaguuggccuugaccucggaacaaacucuauagguugggcacucauaaacgcguauauaaauaaagagcaccuauauggaauugaagccugugggucucgaauaauuccgauggacgcagcuauuuuaggcaacuuugauaaagggaacucgauaagucaaacagcagacagaacaucauacagagggauaaggcgacuacgggaaagacaccuauugagacgagagagauuacaccgcauccuagaucuucuaggcuuuuuaccaaaacauuacucagauucacuaaauagauaugguaaauuucuaaacgacaucgagugcaaacuucccuggguaaaagaugaaacaggcucauacaaguuuaucuuucaagaaucauuuaaagaaaugcuagcaaacuucacagaacaccauccaauucugauugcuaauaauaaaaaaguaccauacgacuggacaauauauuaucuuagaaaaaaggcucuaacacaaaaaaucagcaaggaagaacucgcauggauacuacuuaauuuuaaucaaaaaagaggauauuaccaacucagaggcgaagaagaagaaacacccaauaaauuaguagaauacuacucauugaaaguugagaaaguugaagacucaggagagagaaaaggaaaagacacaugguauaauguucaucuagaaaacggaaugauauaucgacgaaccucuaacauaccccucgauugggaagggaaaaccaaagaauucauagugacaacagaccuugaggccgauggcucaccuaaaaaagacaaggaagggaauauaaaacgcagcuuccgagcaccaaaagaugacgacuggacguuaauaaaaaaaaaaacagaagcagacaucgauaagauaaaaaugacaguuggagcguacauuuacgacacucuacuucaaaagccagaucaaaagauaagagguaaacucguaagaacgaucgaacgaaaauacuacaaaaaugaacuauaccagauucuaaaaacccagucagaauuucacgaagaacugagggauaaacaauuguauauagccugcuuaaacgaacuauacccaaacaacgaaccacgucgaaacagcauaagcaccagggauuucugucacuuauucauagaagacauaauauuuuaucaacguccauugaaaucuaaaaaaagccugauagauaacugcccauacgaggagaacagauacauagacaaagaaucaggugaaaucaaacaugcgagcaucaaaugcauagccaaaagccacccuuuauaccaagaauuuagguuauggcaauuuauagucaaucugagaauauaccgaaaagaaacggauguagauguaacacaagaauuacucccaacagaggcugauuauguaacccuauuugaguggcucaacgagaaaaaagaaauugaccaaaaggcuuuuuucaaauaucccccguuuggauucaaaaaaacaacaaguaacuaucgauggaacuacgucgaagauaagccauacccaugcaaugaaacacaugcucaaauaauagcacgacuaggcaaagcccacauaccgaaagcauuccucucaaaggaaaaagaagaaacauuauggcauauccuauauagcauugaggacaaacaggaaauagagaaagcacuacauuccuuugcuaauaaaaauaauuuaagugaagaauucauagaacaauuuaaaaauuuuccaccuuucaaaaaagaauauggaucauacuccgcuaaagcaauuaaaaaacuauuaccauuaaugcgcaugggcaaauauuggagcauagaaaacauagauaacggaacaagaauacgaauaaacaagauaauagacggagaauaugaugagaacauaagagaacgaguuagacaaaaagcgauuaaucucaccgauauaacccauuucagagcuuuaccccuauggcuagcaugcuauuugguauacgauaggcauucugagguaaaagauauagugaaauggaaaacaccaaaagauauugaucuuuauuuaaaaagcuuuaaacaacacucucuucguaacccaaucguugaacaagugauuacagaaaccuuacgaaccguaagagauauauggcaacagguagggcauauagacgaaauucauauagaacuagggcgagaaaugaaaaacccagcagacaaaagagcacgaaugucccagcaaaugauaaaaaaugaaaacacuaauuuaaggauaaaggcacuacuaacggaauuccuuaauccagaauuugggauagagaaugugagaccuuauucccccucacaacaggauuuacugagaauauacgaagaaggcguacuaaacagcauacuagaacuucccgaagacauaggaaucauucugggaaaauuuaaucagaccgacacuuuaaaacgaccaaccagguccgaaauacuccgauauaagcuuuggcuggaacagaaguaccgaucaccauauacaggagaaaugauaccucuaagcaaauuauuuacaccagcauacgaaauagaacauauaauaccccaaagcagauauuuugacgacucccuuaguaacaaagugauaugugaaucagaaauuaacaaacucaaagacagaagccucggauaugaauuuauuaaaaaccaccacggcgagaaagucgaguuagcauucgacaaacccguagaaguccucucaguagaagccuacgaaaagcugguucacgaaucuuauagucacaacagaucaaaaaugaaaaaauuacuaauggaagacauaccagaccaauucauagaaagacaacuaaacgauucacgauacauaucaaaagucgucaaaucauuauuaucgaauauuguaagagaagaaaacgaacaagaagcaauuucgaaaaacguaaucccaugcacaggcggaauaacagaccgucuaaaaaaagacuggggaaucaacgauguauggaauaagauaguacuaccaagguuuauucgauuaaaugaacugacugaaaguacaagauucacaucaauaaacacuaacaauaccaugauaccaucaaugccauuggaacuacagaaaggauucaauaaaaaaaggauagaucaccggcaccaugccauggacgcuauaauaauagcuugcgcaaauagaaacauaguuaauuaccuuaacaacgugagcgcaucaaaaaauaccaaaauaacaagacgugauuuacaaaccuuguuaugucauaaagacaaaacugacaacaacggaaacuauaaguggguaaucgacaagcccugggaaacauucacucaagacacacuaacagcacuacaaaaaauaacaguuucuuuuaaacaaaaccuuaggguuauuaacaaaacaaccaaccauuaccaacacuaugaaaauggaaaaaaaauuguauccaaucaaaguaagggagauucuugggcuauacguaaaagcaugcauaaagaaacuguucauggagaaguaaacuuaaggaugauaaagacaguaaguuucaaugaagcuuuaaaaaaaccccaagcaauaguagaaauggaccuaaaaaaaaaaauauuagcuaugcuagaacuuggauacgacaccaaacgaauaaaaaauuacuucgaagagaacaaagacacauggcaagauauaaauccaagcaaaauaaaaguauacuauuucacaaaagaaacuaaagaucgauacuuugccguuaggaaaccuauugacacaucuuucgacaaaaaaaaaauaaaagagucaauaacugauacugggauccagcaaaucauguuaagacaccuagagaccaaggauaacgauccaacauuagcauucagcccagacggaauagacgaaaugaauaggaacauacuaauacucaauaaagguaaaaaacaccaaccuauauauaaggucagagucuaugaaaaagcugaaaaauucacuguaggccaaaaagguaauaaacgcacaaaguuugucgaagccgcaaaaggaacuaaccuauucuuugccauauacgaaacagaagagaucgacaaagauacaaaaaaagugauacguaaacguucuuacuccacgauuccacugaacguaguuaucgaaagacaaaaacaaggccuauccagugcuccagaagacgaaaauggaaaucuaccaaaguauauccuaagccccaacgaccuaguauacguuccaacccaagaggaaaucaacaaaggggaagucguaaugccaauagaucgggacagaauuuacaaaaugguggacucuagcggaauaacagcuaacuucauaccagcaucaacugcaaaucuaauuuucgcauuacccaaagcaacggcagaaauauacuguaacggagaaaauugcauccaaaaugaauacggaauaggaaguccucaaucaaaaaaucaaaaagccauaaccggagaaauggucaaagaaauauguuucccgauaaaagucgacagacucggaaauauuauucaaguaggaucauguauuuuaacgaauuga

SEQ ID NO: 9237 - RNA, 4563 nt, Artificial Sequence
  Cas9 variant
augaagaaaauagugggauuggaccuugguacuaacaguaucggaugggcccuaauaaaugcuuacauagacgaauauaauaaagaacaucucuauggaauagaggccuguggaucaagaauaauaccaauggaugcagcaauauuaggaaacuucgacaaagggaauagcauuucccaaacagcugaccgaacaucauauagaggaauaagaagacuucgagaacgacauuuacuacgccgugaaagacuacacagaauacucgauuuacuaggauuccuaccaaagcacuacuccgauagcuuaaauagauacgguaaguuccuaaacgauauugaaugcaaacuucccuggguaaaagacgaaacaggauccuauaaauucauuuuucaagagucguuuaaagaaauguuagcaaauuucacagagcaccacccgauccucauugcuaacaacaaaaaggucccauacgacuggacaauuuacuaucucagaaaaaaagcucuuacucaaaaaauauccaaagaagagcuagccuggauuuuauugaacuuuaaccagaaaagagguuacuaccaauuacggggagaggaagaggaaacaccgaacaaguuaguagaauacuacucuuuaaaagucgaaaaaguggaagauaguggcgaaagaaaaggaaaagacaccugguauaauguccaccucgaaaaugggaugauauauagaagaacuaguaauauaccucuagauugggaggguaagacaaaagaauuuauagucacaacagaccuggaggcggacgguucgccaaaaaaagauaaagaaggcaauauuaaacgaucauuccgagcaccaaaagaugaugauuggacacuuauaaaaaaaaaaacagaagcagacauugauaaaauaaaaaugacagucggggcauauaucuacgacacgcuacuccaaaaaccugaucaaaaaauuagaggaaaacuaguaagaacaaucgaaaggaaauauuauaaaaaugaacuguaccaaauauugaaaacccaauccgaauuccacgaagaacuacgagacaaacaacuuuacauagcaugucuaaacgaauuguaucccaacaacgaacccagaagaaauaguauaucaacccgugauuucugucaccucuucauagaagacauaaucuucuaucaaagaccgcuuaaaucuaaaaaauccuuaauagacaauugcccauacgaagaaaacagauauauugauaaggaaucaggugaaauaaagcacgcuucaaucaaauguaucgccaaaucccacccucucuaucaggaguuuaggcuuuggcaauuuaucgugaaccuacgaauauaccggaaagaaacagauguagaugucacucaagaauuauuaccaacagaagccgauuacguuacacuauucgaguggcucaacgaaaaaaaagaaaucgaccaaaaagcuuucuucaaauauccccccuuuggauucaaaaaaacaacaaguaacuauagauggaauuacgucgaagacaaacccuacccauguaacgaaacacacgcccagauuauagccagacuaggaaaagcacauauccccaaggcauucuuauccaaagagaaagaagaaacuuuauggcauauccuauacuccauagaggauaagcaagaaaucgaaaaagcgcuacacucauuugcaaacaaaaacaaccuuucagaagaauucauagaacaauucaaaaauuucccacccuuuaaaaaagaauaugguagcuacagugcuaaagccauaaaaaaauuguuaccccucaugagaaugggcaaauauuggucaauagagaacauagacaaugguacaagaauaagaauaaacaaaaucauugacggagaauaugacgaaaacauacgagaaagaguacggcaaaaagcaauaaaccuaacagauauuacacacuucagagcauugccacuauggcuugcaugcuauuuagucuacgauagacacuccgaagugaaagacaucgucaaauggaagauuccaaaagauaucgaucuguaucuaaaaaguuucaaacaacauucacugcgaaacccaaucguugaacaggucaucacagaaacauuacgaacaguaagagauaucuggcagcagguaggacacaucgacgaaauacauauagaauuagggagagagaugaaaaacccagcagauaaacgugcacggaugucacaacaaaugauuaaaaaugaaaacacaaauuuacgaauuaaagcauuacuuacagaauuccuaaaucccgaauucggaauagaaaacguucgcccauauagcccaucacaacaagaucuccugaggauauacgaagaggguguuuuaaacagcauucuugagcuacccgaagacauugggauaauuuuagguaaguucaaucaaacugauacccuaaaaagacccacgagauccgaaauucuccgcuacaaauuauggcuagaacagaaauacagaucaccauacacuggugaaaugauaccacuuucaaaacuauucacaccugcauaugaaauugaacacauaauuccccaaucaagauauuucgaugacaguuuaucuaacaaaguaauaugugaauccgaaauuaauaaauuaaaagaccgaagcuuaggauacgaauuuaucaaaaaucaccacggagaaaaagucgaacuugcauuugacaaaccuguagaagugcuuucaguagaagcauacgaaaaauuaguacaugaaucauacucccauaaccggucaaaaaugaaaaagcuacuaauggaagauaucccagaucaauuuauagagaggcaauuaaacgacucaagauacaucaguaaaguagugaaaucauuacucaguaacauaguccgagaagaaaaugaacaagaagcaaucagcaaaaauguaauaccaugcacgggaggcauaacugaccggcuaaaaaaagauuggggaauaaaugacguauggaacaaaaucguauugccacgcuuuauacgcuugaacgaacuaacagaaucaacacgauucacuagcaucaauaccaacaauaccaugaucccuucuaugccacucgaacuacaaaaaggguuuaacaagaaacguauagaccaucgacaucacgcuauggacgccauaauaauugccugugcaaacagaaauaucgucaauuacuugaauaauguuucagcuagcaaaaacacaaaaaucacacguagagaccuacaaacacuauuaugucauaaagauaaaacagacaacaacgguaacuacaaauggguuauagacaagccaugggaaacauucacacaagacacacuaacagcuuugcaaaaaaucacuguaucguucaaacaaaaccucagggucauaaauaaaacuacaaaccauuaucagcauuacgaaaaugggaaaaaaauaguaagcaaucaaagcaaaggcgacaguugggcaauaagaaaaagcaugcacaaagaaaccguacacggugaagucaaucuacgaaugauuaaaacaguaucuuuuaacgaggcacuaaaaaaaccgcacgcuauugucgaaauggaucuuaaaaaaaaaauccuagcuauguuagaacucgguuaugacacaaaacgaaucaaaaauuacuucgaagaaaacaaagacacauggcaagacauaaaccccucaaaaauaaaagucuacuacuuuacaaaagaaacgaaagauagauauuuugcaguuagaaaaccaauagacacaucauucgauaaaaaaaaaaucaaagaaucaauaacugacaccggcauccagcaaauuaugcuacgacauuuagagacaaaagacaaugacccgacacucgcuuucagcccagauggaauagaugaaaugaacagaaauauccuuauacuaaacaaaggaaaaaaacaccaacccauuuacaaaguacgcguauaugaaaaggcagaaaaauucaccguuggacagaaaggcaacaaaaggacuaaauuuguagaggcagcuaaaggcacaaaucucuucuucgcaauuuacgaaacugaagaaauugacaaagauacaaaaaaaguaauaagaaaaagaaguuacucuacaauaccauuaaacgucguaaucgaaagacaaaaacaaggccuuuccucugcaccagaagacgaaaacggaaacuuaccaaaauacauccuuucuccaaacgaccuuguuuacguaccaacacaggaagaaauaaauaaaggagaaguugucaugccaauagacagagaccggauauauaagaugguugacucuucagggauaacugcgaauuucauacccgcauccacagcaaauuuaauuuuugcacuaccaaaagcaacagcagagauuuauugcaauggugaaaacugcauacaaaacgaauauggcaucggauccccacaauccaaaaaucaaaaagcuauuacgggagaaaugguaaaagaaaucuguuucccuauaaaagucgacaggcuaggcaauauuauccaaguaggauccuguauuuuaacgaauuga

SEQ ID NO: 9238 - RNA, 4563 nt, Artificial Sequence
  Cas9 variant
augaaaaaaauagugggauuagaccuggguacgaacagcaucgguugggcacuaauaaaugccuacauagaugaauauaacaaagaacaccucuacggcauagaagccugcggaucuagaauaaucccaauggacgcagccauuuuaggaaacuucgauaaaggaaacagcauuagucaaacugccgauagaaccucuuaucgcgguauaagacgcuugagagaacgacaucuccugaggcgagagcguuuacacagaaucuuagacuuauugggguuccugccaaaacacuauucggauucacucaauagauauggaaaauuuuuaaaugacaucgaaugcaaacucccauggguaaaagacgaaacugggaguuacaaauucaucuuccaggaaucauuuaaagaaaugcuggcuaauuuuacagaacaccacccaauauuaaucgccaacaauaaaaaaguaccauacgacuggaccauauacuaucuacgcaaaaaagccuuaacacaaaaaauauccaaagaagaacucgcauggauauuacuuaauuuuaaucaaaaaaggggcuauuaccaauuacgaggcgaagaggaagaaacaccaaacaaacuaguagaauacuacucuuuaaaaguugaaaaaguagaagacucaggagaaaaaaaaggcaaagacacgugguacaacguacacuuagaaaauggaaugauauacagaagaaccucgaacauacccuuagacugggaagguaaaacaaaagaauuuauugucacaacugauuuagaagccgacggaucuccaaaaaaagacaaagaagguaacaucaaacgaaguuucagggcaccaaaggaugaugacuggacacuuauuaaaaaaaaaacggaagccgacauagacaagauaaaaaugacaguaggagcauacauuuaugacacauuacuucaaaaaccggaccaaaaaauaagagggaaacuaguaagaacaaucgaacgaaaauauuauaaaaacgaacuauaucaaauauuaaaaacacaauccgaauuccacgaagaacuacgggauaaacaauuauacauagccugucucaaugaacucuaccccaacaacgaaccuagaagaaacagcauaaguacacgagauuucugccacuuauucauagaagacauaauuuuuuaccaaaggcccuugaaaucaaaaaaaucuuuaaucgauaacuguccuuaugaagagaaucgcuacauugacaaagaauccggagaaauaaaacaugccuccauaaaaugcauugcaaaaucacauccguuauaucaagaauuucgccucuggcaauuuauaguuaaucugagaaucuacagaaaagaaaccgaugucgauguaacacaagaacuacugccaacagaagcggauuauguuacgcuauuugaauggcucaaugaaaaaaaagagaucgaucaaaaagcauuuuuuaaauauccgcccuucggcuuuaaaaaaaccacaagcaauuaccgauggaauuacguagaagacaaaccuuaccccuguaaugaaacacacgcacaaauaauuacuagauuaggaaaagcccauauaccgaaagcauuucuuagcaaagaaaaagaagaaacacuauggcauauccuuuauucuauagaagauaagcaagaaauagaaaaagcacuccacucauuugcuaacaaaaauaaucugagcgaagaauucauagaacaauucaagaauuuccccccauuuaaaaaagaauauggcucguauucagcgaaagcgauaaaaaaauuauuaccacuaaugaggauggggaaauauugguccauaaaaaacauagacaacggcacacgcauaagaaucaacaaaauaauugacggagaauaugaugaaaacauaagagaaagaguacggcagaaagcgaucaaccucaccgacauaacacauuucagagcuuuacccuuauggcucgcuuguuacuuaguauaugaccgacauucagaaguaaaagacauuguaaaauggaaaacaccuaaagacaucgaucucuaucugaaaucauucaaacaacauucucuaagaaacccaauaguagagcaggucauaacggaaacacucagaacaguaagagauauuuggcaacaagucggacacauagacgagauucauauagaacucggccgagaaaugaaaagcccggccgacaaaagagcaagaaugucacaacaaaugaucaaaaaugaaaacacaaacuuacguauaaaagcucuccuuacagaguuccugaacccagaauuuggaaucgaaaacguacgacccuauagcccgagccaacaagaccuccucagaaucuacgaagagggaguucuaaauucaauauuagaauuaccggaagacauagggauuauccuugggaaauucaaucaaaccgacacacuuaaaagaccaacgcguagcgaaauauuaagauauaaacucuggcuagaacaaaaguacaggagcccauacacaggcgaaaugauuccguuaucaaaacuauuuacaccagcauaugaaauugaacauauuauaccacaaucacgauacuuugaugacucacucucaaacaaaguaauaugugaaagcgaaaucaacaaacuuaaagacagaucauuaggauacgaauuuauuaaaaaccaccacggggaaaaaguagaguuggcauuugacaaaccaguagagguacucaguguagaagcuuaugagaaauugguccaugaaagcuauucccauaacagaaguaaaaugaagaaacuauuaauggaagacaucccagaccaauuuauagagagacaacucaacgauagucgauauauaucgaaagucguuaaaaguuuacucagcaacauugugcgagaagaaaacgagcaagaagcgaucaguaaaaauguaauccccugcacuggaggaauaaccgacagauuaaaaaaagacuggggaauaaaugacgucuggaauaaaauaguauuacccagauucauaagauuaaaugaacuaacagaaaguacuagauucacauccauaaacaccaacaauacaaugauuccaaguaugccauuagaauuacaaaaaggcuuuaauaagaaaagaaucgaucacagacaucacgcaauggaugccauaaucaucgcaugugcuaauagaaacauaguuaauuaucuaaauaacguauccgcauccaaaaauacgaaaaucacacgccgagauuugcaaacauuacuaugucauaaagauaaaacagauaacaauggcaauuacaaaugggucauugauaaacccugggaaaccuucacucaagacacauuaacagcacuucaaaaaauaaccgucagcuucaaacaaaaucuaagaguaauaaauaaaaccaccaaccauuaucaacacuaugaaaauggaaagaagaucgugucaaaccagaguaaaggagauucuugggcaauaagaaaaucuaugcauaaagaaacaguacauggagaagucaaccuacgaaugaucaaaacaguuagucuaaacgaagcauuaaaaaaaccacaagcuauaguagaaauggaucuaaaaaaaaagauacuugcuauguuagaacuaggguacgacacaaaacgaaucaagaauuauuuugaagaaaacaaagauacauggcaagacauuaacccauccaaaauuaagguguacuacuucacaaaagaaacuaaagaucgcuacuucgccguaaggaaaccaaucgacacuucuuucgauaaaaaaaaaaucaaagaaaguauaacggacacaggaauacaacagauaauguuacgucaccuagagacaaaagauaaugacccaacccuagccuucucaccugauggcauagaugaaaugaacagaaacauacuaaucuugaauaaagguaaaaaacaccagccaauauacaaaguacgaguuuacgagaaagccgaaaaguuuacaguaggucagaaagguaacaaaagaaccaaauuuguagaagcggcaaaagggacuaacuuguucuuugccaucuacgaaacugaagaaaucgauaaagacacaaaaaaaguuaucagaaaacguucauauagcacuaucccacucaacgucguuauagaacgccaaaagcaaggccuauccuccgcuccagaagacgaaaauggaaaucuuccaaaauauauucuuucgccaaaugacuuaguauacguuccuacccaagaagaaauaaacaagggagaaguugucaugcccauugacagagacagaauuuauaaaaugguugacucuuccggaaucacagcaaauuucauccccgcgaguacagcaaaccucauauuugcauuaccuaaagcaaccgccgaaauauacugcaauggcgaaaauuguauccaaaacgaauacgggauaggcagcccccaauccaagaaccaaaaagcaauaacaggagaaaugguuaaagaaauauguuucccuauuaaagucgacagauuaggaaauaucauacaaguaggaagcuguauacucaccaauuga

SEQ ID NO: 9239 - RNA, 4575 nt, Artificial Sequence
  Cas9 variant
augaacaaaauccuuggacuagaccuaggcacaaauucaauagguugggcaauaguacagaaagaugaacaagguuuuuaugagaaaauaaucaacgcaggauccagaauaauacccauggaugcagaaacaaugaacaauuucaauaaaggaauuacaaaaucacccgcuucagaaaggacuagguucagaggagcaagaaggcuaauagaaagaucucuacuacgacgagaacgaauacaucgacuauuaaauacgaugaacuaccuaccaccacacuaugcagagaaaauagauuuugugaacagauugggaaaauuuauaggcgaagaagaaccaaaauacgcauauaaaguagaugaacauggcaaauuccaauucaucuuuaaagaauccuuuaaugaaauguuaaaggacuuccaagacaaacagcccgaacugguauuaaauaauaagaaaguaccauacgacuggacgauauacuaucuacgcaagaaagcauuaaacagagcuauuagcaaagaagaguuaggauggauaauacuacaguucaauaacaaaagaggauauuaucaacuaagaggagaagaagaugaaacucuaaccgaaggccaaaagaaagaauacuuugcucuaaaagugauaagaguugaagcagauuccuccagcgcagggaagaaaggagaaguaugguauaacguucaacuugagaacggauggauauacagauguaaaucagaaauaccauuggacugggagggaaaaauaaaagaguucauaguaacaaccgaagucgaugaaaaugacaacguauuaaaagacaaagaaggaaaagaaaaacguaaacuaaaaauaccagaagcgggugacuggacacuacugaaaaagaaaacagaaagugacuuagacaaaagcggaaaaacugucggugccuacauuuacgacacuuuauugagcaacccagaccagaaaaucaaaggaggguuaauaagaacuauagaacgugaacuauacagaucagaacuugaacaaauauuagauaaacaaaaagaguuccaccccgaacuaaaagacggaacgcuauacaauaaaugcguagaagaacuauaccgcagcaaugaaaguagaagaauaucacucagcaacuacgacuuuacgagguuuauuacagaagauguuauauucuaucaaagaccacuaaaaucaaagaaaucgcuuauagauaauuguucauuugaaagacgaaauuacuuaaacccaauuacaaaagaacuagccuacgcgcccauaaaaugcauugccaaaucacacccccuauuccaagaguuuagauuauggcaauuuauuaaaaaccuaagaauaauugaaagagagaaaaucgucggugauaaacucauguucgaucaagacgucaccacagaauuuuuaccuacucaaaacgauuacgugauacuuuuugacugguugaaugaacauaaagaaaucgaucaaaaagcccuacucaaauacccagcauuuaaucugaaaaagaauaucgauaaguacagauggaauuauguagaaaauaaaaguuacccgugcaacgaaacacgagcacuauuaaaagcgaaacuaaauaaagcgggaaauaucccaucagauuucuuagauaaugacaccuuggagucccuguggcacauacucuauaguguggaagauaaauuugaaauagagaaggcccuaaaaucauucgccacaaagaaagaauuacgggaagaacaaacaguagcauucguaaaacaauucauaaacauacccccauuuaagaaagaauauggaaguuauuccgcaaaagcuaucaagaaacugcuacagcucaugagaaugggcucaagguggucagaaaaugaaauuucugauucaaccaaagaccgaauacaaaaacuaauugacggugaaugggacgaauccauaaaaacuagaacaagagauaaagccaucaaacuaaaugaaauaaaugauuuccaaggacugccccuauggcuagccaguuauauaguuuaugaccggcacucagaaucuggagauguuaugaaaugggaaaccccagaagacaucgauuacuaccugaaacacguuuucaaacaacacggcuuacgaaacccuauaguugaagucguagucguugagaccuuaaagguaguuaaagaucucuggaaaaccuauggcuauuucaacgaaauucacauugaacuuggaagagagaugaaaaacccggcagauaaacgaagaucuaugacaaauaagaauauagaaaaugaaaauacgaaucuuagaauaaaagccuuauuagcugaauuagcaaaccauaaagauguagaaggcguacggccauauucaccaagccaacaagaaauccugaaaauauacgaagaagggguccuugauaugcuaacgaaagaggacccugauuacgaaucgauaucaaaaauaagcaaaauggcacuaccaucaucaagugaacucauaagauacaaauguuggcuagaacagaaauacagaagcccauauacgggacaaguaauacccuuagcaagauuauuuaccagcgaguacgaaauugagcauauaauaccacaaucacguuacuucgacgauagcuucucuaacaaaguaauaugugaaagugccgucaacaaagauaaagacaaccuacuagcguaugaguauauaaagcaaaaugaagggaaaauaauagaaaucggacucggaaagaagguuaaauuauucacugccgacuccuauacagaauuugugcaaaguaauuauguaggaucaguagcuaaaaagaagaaacucuuaauggauacaaucccagacucguuuauaaaaagacaacuaaacgauucgagauauauaucaagagagauaaugaaauuacuaagcucugugguucgcgaaaaagaagaggaagaagaagaggaagaagaagaagcaauaaguaaaaacgucauugucugcaccggagcaaucacggacaaauuaaaaagggaauggggacuuaacgauguauggaacacaauaaucuacccucgcuuugaacgauuaaaucaacuuacaaacagcgauaaauucggacaaugggaaaauaaacaaggcaaaaagguauuucaaauagaaaugccuuugaaacuucaaaaaggauucaauaagaaaagaauugaucacaggcaucaugcaauggaugcaauagucauugcaugugcaacacagagccauguaaauuauuuaaacaacgaaucagcacacaguaacaguaaagaaaaacgauauuacuuacguagaaaacugagaagaauugagauucuagagaaacaagaguuaaaagacggaguaacaauaacgaagaaaauagaaguagcgaaagaauuuaacaaaccauggccgacauuuacacaagacgcacaugaaguacuacaaucaaucauagugucauucaaacaaaaucuacggguagugaacaaagcuacaaaccgauaugcaugcuuuguuaacggaaagaaagaaaucguaaaacaaaguaaaggagaaagcugggcgauacgaaaacccaugcauaaagauacaguaagcgcugcggucucacuaaggaaaauaaaaacagucaguuuaucccaagccaucgacgacuggacgaacauaguugacaaaucacuaagaaaagaaauaggacuacuguauaguaaauacggacagaacggaagcaaaaauaucauaaaauauuucaaagauagagauaauaaacacaacgggcuagauguuucaaaaguaaauguacacuacuucgacaacgacuaugcggccucaagaguagcuuuagaccacaaguucaacucagcgaaaauaaaaucaauaacggacacaggcauacaaacaauacuacucaaacaucuagaaucauauaaugagauaaauggggacaagauaauagagcacccagagcuugccuucagugccgacggauuagacauucugaaugcaaauauuacaaaacuaaacaacggaaaauuccauaaaccaauaaagaaaguacguaaaacugaaacacuaggauuaaaauucauaguaggacaaacagguaauaaaagaaagaaauacguagaagcagcagauggaaccaaucuauucuuugcuauauaugugaguguagauggcauaagauccuauaaaacaauaccauugcgugagguagccgagagacuaaaagaaggccuaauacccgugccagagaaaaaugauaaagacgaccacuuacuauucuggcuuaguccuggagauuuagucuacguuccaaguaucgaagaagaagguagaauugucgaaauagaaaauauaaaacaagacagaauauacaaaguaguuaguugcacagagaaugaaugccacuguauuccucauuucgucgcuagucccauaguuaaaacagaugaacucggagcuaacaauaaagcucaaagggcguggucuggagaaaugauuaaagaaacaugcauaaaaauaaaaaugaaucgucuuggacaaauugugaaaaucuga

SEQ ID NO: 9240 - RNA, 4581 nt, Artificial Sequence
  Cas9 variant
augaagaagauauuaggacuagacuugggcacaaauucaauaggaugggcuguguuaaacgcagccgaugacaacagccucaaauauaucgaagccgcaggaagcagaauuauaccaauggacgcagccauauuaggggauuucgaccgagguaauucaauaucacaaacugcugaaagaaccagaauccgaggaaugagacauuuaagagaacgauaccuccuuaggagagcgagauuacauagaauuuuaaaccuucuuggauucuuaccauuccacuacgcacaagacauagauagauacggaaauuucagugcagacauggaaccaaaaauagcauggcguaaaaauuuagaaggagaauuggaguucauuuuuauugaaucauuuaaugaaauguuagaagauuuucgaaagaaccaaccagagcuaguagcugacaacaagaaagugccauacgacuggguuauauacuaucuaagaaagaaagcauuggaaaagaaaaucucaaaagaagaacuagcguggauccuacuaaacuuuaaucagaaaagaggcuauuaucaacuaagaggggaagacgaugaugaaucaaugaaaaccgcaaaaacacgacaauacuucgauaaacaaauaaucaaaaacaucauagauacaaaccaaacauauaaaggucaacgaauccuaauaguagaacuucaaaauggugacaaagguaaaaucuucaagaaagaaaucccagacuggauaggacaagagaaaaauauaauaguaacaguggauauagauaaagacggaaacgacaaauaugaagaaucagggaguuuaucaugcagguucaaaauuccaacagaugcagaaugggaauccgaauggaaacuaauaaaaaugaaaacucaaaaagaucuagaugaaucaaacaaaacuguaggaaccuauauauaugacaguauccuacaaaacccaacacaaaaagugagagggaaauuaguacgcacgauagaaagaaaauacuauaaagccgaacuaaaacaaauccuagaaaaacaaacugaguuccacagcgaauuacaagauaaagaucuauauauagaaugucucaacgaauuauauuccaacaacgacacacacagaaacgcaauuaccgauagagacuuugucuaucuauucaugaacgauauacuauucuaccagaggccccucaaaucaaagaaaucuuuaauagauaauugcccauaugaacgcaauauauauauagacaaagaaaccggggaaaucaaauacucaccaaucaaauguauagcaaaaucccaucccuuauuucaagaguucagauuauggaaauuuauaucgucaauaagaauauaccagagagaaagcguaguagagguggucgacaaacaauuagauuuauuuaguagccaaucuacaucaguucaaaaauuaguuaccgauguagacgugacugacaaauuuuugacaugcgagaaugacuacguugcucuauuugaauggcucaacaaaaagaaaauaauagaccaaaaagaauuuuuaaaguacaggccauucggauuaaaaggagacauagacaauuaucgauggaacuauguggaggacaaaagcuauccaugcaaugaaacucaugcaaugauacugaccuacuuugcaaaagcaggaauaucagaagacauacuaacaaaagaaauggaggaagcauuauggcauauacuuuauuccguagaagauagacaggaaaucacuaaagcacuacgaacauucgccaguaaguaucauuuaucagacucuuuuguuaaggucuucaguaacauaccaccauuuaagaaggaauauggaagcuauagcgcaaaagcaauaaagaaacuccugucgcuuaugagaauggguaaauauuggucagaagaugcuaucgacgucaauacccgagaaagaauagacaaaauagucaccggagaauaugaugagaaaauccgagacagaguuagagagaaaaccauacgacuaaacgacauccgacacuuccgcgcguuaccugauuggcuugcaugcuacguagucuacgaccgacacagugaaacucgagaaaucacagaauggaaaucacccgaagaaauugacgaauauauaagaaacuuuaaacaacauuccuuacguaauccaauagucgaacaagugauuacagaaacauugagaacaguaagggauauauggaaacaaguggguuguaucgacgaaauucacguagaauuagguagagaaaugaaaaauccagcagacaaaagaaaacggaucacgucacagauaauugaaaaugaaaacgcaaaccuaagaguuaaagcacucuuaacagaauuuguaaacccugaguucgaaauagaaaacguaagaccauauagucucggacagcaagacauacuaagaauauaugaagauggaguccucaacagcguugcagaaguaccaggcgacaucgcugguauacugaagaaauucaaugaaaaugacgcaaagaaacguccuacaacgucagaaauacuaagauacaaacuguggcucgaacaaaaauauagaagucccuacaccggugagaugauaccauugaguaaacuguuuacaagcgcuuacgaaauagaacacguaauuccacaauccagguauuucgacgacuccuucuccaauaaaguaauaugugaagcagaagucaauaaauuaaaagauaacgcucuggguuaugaguucauuaaaaagcaccacggugaaaaaguagaacucggauuuggaaaaauugucgaaauauuuagcgugucaguauacgaacaauuuguaaaagacaauuauucacgaaaccgaggcaagaugaaaaaguuauuaauggacgaaauuccagaacaauuuauagagagacaauuaaaugacucucgauauaucaguaaaguaguaaaaaccuuauuaaguaacguaguuagagaaaaagcagaacaggaggcaguauccaaaaaugucauaguuugcacgggcggcguaacugaucgcuuaaagaaagacugggggauaaacgacguuuggaacaagauuguucuaccaagauucuuacgacuuaaugaauuaacaaacucaacuaacuucacagccaaaaacgccgcaggaaacgagauaccugcuaugccauuggaacuacagaaagguuucaacaaaaagagaauagaucaccggcaccaugcaauggacgcgauaguuauagcaugcgcuaauagaaacaucguuaauuacuugaauaaugaaucagccucacgcaaagcuaaaauauccaggcaugacuuacaagcuauacucugcgacaaagucagaacagacgacaaaggaaacuaccaauggcgagucaagaaacccugggauaccuuuacacaagacguauacguagcacuugagaauaucauuguaucuuucaaacaaaauuuaagaguaaucaacaaaacauccaacuacuauuggcauuaugaaaacggaaagaaaguauuaguaaaacaaguaaaaggugauucaugggcaauaagaaaacccaugcauaaagacacaguguuuggagaagucaaccuacgaaaggucaaauccgugagcuuaaacgaagcccucaaaaauccccaauucauaguagaaaaagaccuaaaacgacaauuacuaagccuacuacaacaaaacuucgauauaaagaaaauuaagaaauacuucgaagaacauaaagacauauggagcgauauuagucuaucaaaaaugaauauauauuacuucacaaaagaaacaaaagaccgauacuucgcuacacgaaaaccauuagaugcaaguuucgacaagaagaaaauugaaaguugcauaacggauacuggaauacaacaaauacuccuaagacaccuugaacuaaaagaaaacgauccugaaagagcguuuucuccagaugggauagaugaaaugaauagaaauauaauccaacuaaacaaaggaaaaggccaucaccccauagcgaaagucagaguuuaugaaaaagcagauaaauuugaaguaggucaacguggaaacaaaaguucuaaauucguagaagcagcaaaagguacaaacuuauuuuucgcgguauacgaaacugaauaccccgaugagaaaacuaacuccauaguacgcaaaaggaauuacgcaaccauaccacuaaacauugccauagaacgccaaaagagaggccucucgacagcaccagaagacgaaaaaggcaacguucccuccuuuguacuaagcccgaaugauuuaguauaccuaccuacaucagaagauauugucaauggucacauaacacaaccuauagauaaaucaaggauauacaagaugguaucaucuucaggcagucaaugcuucuuuauaaaacacaauauagcaaacauuauuguagacaaauacgaguucagcccauugaauaaaauggaacgugcaauuucaaacgaaaugaucaaagagauaugcauaccagucaaagucgauagacuagguaacauagucaaacuuggaaagagugaauga

SEQ ID NO: 9241 - RNA, 4581 nt, Artificial Sequence
  Cas9 variant
augaaaaaaauucuaggacuugaucuagggacaaacucgauaggaugggcgguccuaaacgcagcagaugacaauucauuaaaauauauagaagcugcuggaagucgcauaauuccaauggaugcugcaauacuaggagauuucgauagagguaacaguauaucacagacugcagaaagaacgagaauacgaggcaugagacacuuaagagaacgcuaucuacuaagacgagcaagauuacacagaauauuaaaccuauugggauuucuaccguuucauuaugcgcaagauaucgauagauacggaaauuuuucggcugauauggagccaaaaauagccuggugcaaaaauuuagagggugaguuagaauucauauuuauagaaaguuuuaacgaaauguuagaggacuucagaaaaaaucaaccugaacuagucgcagauaacaagaaaguaccuuaugacuggguaauauacuaucuaagaaaaaaagcccuagagaaaaaaauuagcaaagaagaacuagcguggauacuauugaauuuuaaccaaaaacguggauacuaucaacuaaggggggaagaugaugacgaaucgaugaaaaccgcaaaaacaaggcaauauuucgauaaacaaauaauuaaaaauauuauagauacaaaccagacauauaaaggacaacgaauacuaauagucgaacuacaaaacggcgacaaaggaaaaaucuucaaaaaagaaauucccgauuggauaggccaagaaaagaauauaauaguaacaguagacauagauaaagauggaaacgacaaauacgaagaaaguggaagcuugaguugucgcuucaaaaucccaacagacgcagagugggaaagcgaauggaaacuaauaaaaaugaaaacccaaaaagaucuugacgagagcaauaaaacuguuggcacauauauauaugauucuauucuccagaaucccacacaaaaaguaagaggcaaguuagugcguacuauagaaagaaaauauuauaaagcagaauuaaagcaaauauuggaaaaacagacagaauuccauagugaacuacaagauaaggaccucuacauagaaugccuaaacgaacuauacucgaacaaugacacacacaggaacgcaauuacagauagagacuucguauaccuauucaugaacgacauacucuuuuaccagcgaccucuaaagagcaaaaaaagcuugauagauaauugcccguacgagcguaacaucuacauagauaaagaaacaggugaaauaaaauauuuacccauaaaauguaucgcuaaaucccacccauuauuccaagaauuccgccuauggaaauuuauaaguucaauuagaauuuaucaaagggaaagcguaguugaaguuguggacaaacaacuggaccucuuuaguucacaaucaacaucaguacaaaaacuaguaacagacgucgaugucacagacaaauucuuaaccugugaaaaugacuacguagcccuauucgaaugguuaaacaagaaaaagauuauagaccaaaaagaauuuuuaaaauauagaccuuuuggccucaaaggggauauagauaacuauagauggaauuacguagaagacaaaucauauccaugcaacgaaacgcaugcaaugauuuuaacauacuuugcgaaagcaggaauaagugaagauauccugacgaaagagauggaagaagcuuuauggcacauacuauacucaguggaagacagacaagagauaacuaaagcauuacgaaccuucgcuagcaaguaccauuuaucggauucguucguaaaaguuuuuucaaauauaccacccuucaaaaaagaauauggaaguuauagugcaaaagccauuaaaaaauuauuaucauuaaugagaaugggaaaauauugguccgaggaugcaaucgauguaaauacacgugagaggauagacaaaauaguaacuggcgaauaugacgaaaaaauuagagauagaguccgugaaaaaacaauaagauuaaaugauauccgacauuuuagagcgcuacccgacugguuagccugcuacguuguauaugacagacauucagaaacgagagaaauaacugaauggaaaagcccugaagagaucgaugaauacauaagaaauuuuaaacaacauucauugagaaacccuauuguugaacaaguaaucaccgaaacuuuacgaaccguacgugacauauggaaacaaguuggguguaucgaugaaauacauguagaacugggaagagaaaugaaaaaccccgcagacaaacgaaaacggauaacaucacaaaucauagaaaaugagaacgccaauuuacgagucaaagcacuauuaaccgaauucguaaacccggaauuugaaauagaaaacguccgcccauauagccuaagccaacaagacauauuacgaauuuaugaagacggagugcuuaauaguguugcugaaguccccggagauaucgcaggcauacuaaaaaaauuuaacgaaaacgaugcgaagaaaagacccacaacgucagaaauucuucguuauaaacuauggcuagagcaaaaauacagauccccuuacacaggagaaaugauaccccuuuccaaauuauuuacaucugcguacgaaauagaacaugugauaccacaaucuagauacuuugacgauucauuuucaaauaagguuauaugcgaagcugaaguuaacaaacuaaaggacaacgcauuaggcuaugaauucauaaaaaaacaccacggagaaaaaguagaauuaggauucggaaaaauaguagaaauuuucucaguuucagucuaugaacaauuugucaaagacaacuacucgcgaaacagagguaaaaugaaaaaauuauuaauggaugaaauucccgaacaguuuauugaacgacaauuaaaugacucacgauauauaaguaagguuguaaaaacacuacuuuccaaugucguacgagagaaagcagaacaagaagcagugucaaagaacguaauuguaugcacaggaggagugacagaucgauuaaaaaaagacuggggaauaaacgaugucuggaacaaaauaguacuuccucgauucuuacgacuuaacgaauugacuaacaguacuaauuucaccgcgaaaaacgcagccgggaacgaaauuccggccaugccacuugaacuacagaagggauuuaacaaaaaaagaauugaucaccgccaucaugcaauggacgccaucguaauagccugugcuaaccgaaacauagucaauuauuugaauaaugaaagcgccucacgaaaagccaaaaucucaagacaugaucuccaagcaaucuuaugugauaaaguucguacugaugacaaagguaacuaucaguggagagucaaaaagccaugggacacuuucacucaagacguguacguagccuuagaaaauauuauaguaucauucaaacaaaaccuccgaguaauuaacaaaacuagcaauuauuacuggcauuaugaaaacggaaaaaaaguccucguaaaacaagucaaaggcgauucaugggccauuaggaaacccaugcacaaagauacagucuuuggagagguaaaucuuagaaagguaaaaaguguaucauuaaaugaggcgcuaaagaauccccaauucauaguugaaaaagaucucaaaagacaauuacugucccuguuacaacaaaacuuugacauaaaaaagauaaaaaaguacuuugaagagcacaaagauaucuggucagacaucagccuaucuaagaugaacauuuacuauuucacgaaagaaacaaaggacagguacuuugccacaagaaaaccguuagaugcgagcuuugauaaaaaaaaaauagaaucauguauuaccgacacagguauacaacaaauacuauuaaggcacuuagaguugaaagaaaacgauccagaaagagcuuuuaguccugacggaaucgacgaaaugaauaggaacauuauacaacuuaauaaaggaaaaggucaccauccgauagcgaaaguaagaguuuaugagaaagcagauaaauuugaaguuggacaaagagguaauaaaucuucuaaauucguagaggccgcaaaaggaacgaacuuguuuuucgcaguuuacgaaacagaauacccugacgaaaaaaccaacuccaucgucagaaagagaaauuacgcuacaauaccacugaacauagccauagaaagacaaaagcggggacucaguacagcaccugaagacgaaaaggguaacguaccauccuuuguucuuagcccuaacgacuuaguuuaccucccuaccagugaagacauaguuaaugggcacauuacacaaccgauagauaaaucaagaauuuauaaaauggucaguaguaguggaucccaauguuucuuuauaaaacacaacaucgcuaacauaauaguagauaaauacgaauuuucaccauuaaacaaaauggaaagagcgauaagcaaugaaaugauuaaggaaauauguauaccaguaaaaguagacaggcuaggaaauauaguaaaauuaggaaaaucagaauga

SEQ ID NO: 9242 - RNA, 4584 nt, Artificial Sequence
  Cas9 variant
auggccaaaauccuaggucuagaccuagggacuaauucaauaggaugggcaauagucgaaaaggacggaaacgauuucucauuaguugacaaaggcguaagaauauuuagcgaaggagucaaaagugaaaaaggaauagaaaguucacgugcagcagaacgaacaggauaccgauccgcccguaaaauaaaguaucgaaggaaacuaagaaaauacgaaacacugaagguacuuucauuaaacgggaugugcccauuauccaucgaagaaguagaagaauggaaaaagucaggauuuaaggaauacccauuaaacccggaauuuuuagagugguuacgaaccucagacgacgaaaacauaaacccuuacuucuuccgagauaaagcaucgaaacagaaagucacccuuuuugaaguaggaagagcauuuuaccauauagcgcaaaggagagguuucuuaagcaacagauuagaccaaagcgcagaaggcauauuggaggaacauuguccaaaaauugaggccuuaguugaagacuugaacucaacagacgaaauauuaaccucccuuaaagauuauuucuuugauacgggaauacuagaugcuaacgaaaaaggaggauuugcaaaggaucuagacgaaggugacaaaaaacucguuagccuguauagauccauucaagcaaucguaaaaaagaaugacacagacuuugaaaaagggaaagcagaaaucauagagagauuaaacaaaaaagauguuuuaggcaaaguuaaaggaaaaaucaaagacauaucacaagccaugcuagaagguaacuuuaaaaccuuagggcaauauuucuucagcuuguacaauaaagaacgaauucgaaaccaauauacgagucgagaggaccauuacuuagaggaauucaagauaauuugcaaauuccaagggauaggcucaauaaaccaaaacgaaaagcugccagaaaaaaaauucgaaggucucgcaaaagaauuauacaaagcuauauucuuccaaagaccacuaaaaagccagaaaggauuaauagggaaauguucguucgaaaaaagcaaaaguagaugugcuauaagccaccccgauuuugaagaaaaaaggaugugggaauauuuaaacacaaucaaaauugggacacaaucugaaaaaguauugcguuuccuaucucaagaagaaaagcuaaacuugauaccaaaauuucuaagaaaaaaagauaacuucaauuuugaagaucucgccaaagaacuaaucgaaaaaggggcaaccuucggauuuuauaaaucgucaaaacgagacaguuuucacuauugguucaacuauaaaccaacagacaccguaagcggaugucccguuagcgcgagccuaaaaagcguaguaggcgaagacuggaaaacaaaaaguuucaucuacaaaacaacaaacaguaaaggaauagaaguuagucgcacgguaaauuauaaagacuuauggcacuuguuaucggugucuaccagugauauuuaccucuaugaauacgccaaaaacaaacuaggauuagaagauaaaaaugcaaaagcauucaguaaaaucaagcuuaaaaaggacuuuggaaaucucagccugaaugcaaucaacaaaauacuuccuuacaugagggaaggacuccuauauagucacgcuguauucauggcuaauauagagagcauaguagaugaaguaauauggaaugaccuaggacaaagaaaauauauacaagacaagauagcagcuauaauugcgaacaauauagucgauaacggccugcuagaaguaguaaauggacucauaaaagaaugcaaaguagacggcgcguauuauaguaaagaagcggccgacacuuacagaaaagauuugagcaaaaaacuaguaaguuuuuuuaaauuucaucauauagacgauggaaucaaacaagaaacaauuuuaaaugaacuauuuccaguauucaucgaacaacuaaaagcacaugaauucauuaaaguuaaaagauuagacgaaaaaguacuugaauuccuaaaaggggaaaaucaggauggcgaaguauuuuguaacaacgcaaaacaauuaaaaaaacuguaccacccaucggauaucgaaguuuucaaaaaacaaauugucaaagauaaagacggaacugagacaggccaauugauucuuggaucaccacuaaccaguucaaucaaaaauccaauggcaaugagagcgcugcaucaacuaagaaaaguauuaaauacauuaauagucgaagaacaaguagauuccuccacccgaauccauauagagauggcacgagaauuaaaugacgccaauaaacguaaaggaauacaagauuaccaaaacgaaaacaaaaaagaacgagagaaguaccgagacgaaauaaaaaaauuauacuuagcugaaugcaauaaagaaauugagcccacuguagacgauuuacuacgauaucagcuauggauagaacaagaccgaaaagaaauauacgaaaaugguaauucaauaucaauaugcgauaucauaggagacaacccagcauaugauauugaacauacaguuccacguagcauaagucaagauaacagucaaaugaacaaaacucuauguucccaaaaauuuaaucgagacgucaaaaaacagaaaaugcccuuugaacucggaaaccaccuagaaauacucccaagaaucgcccauuggaaggaagaagccgacaaccuauccagggaaaucgaaaugauuauaagaucaacuaaaaccgccgcuacaaaagaagcuaaagacaaaaaaauacgacgaagacauuaccucacacuucggagagauuauuuacaaggcaaauaugauagguuuauauggacagaacccaaagucggguuuaaaaauagucaaauccccgauaccggaauaaucacccgauaugcacaagcauaucuuaaaagcuauuucaacagaguagaaaguguuaaagguggaaugguagcagaguucagaaaaauuugggguauacaagaaucauaccaagaaaacggaaaaaaauauuuuaaagaaaaagauagaagcaaacacacgcaucacaccaucgaugcaaucacaauagccugcaugacgaaagacaaauacgacguauuagcucacgccuggacacucgaagauaaagaacaaauuaccgaagcaagaaaaauaguggcagaaucaaaaccauggaaaacauuuaaagaggaucucaaaaaaauagaagaaggaauacugguaucacacuacacaccagacaacguaaagaagcagucgaagaaaauuguaagaguacguggaagaaagcaauacguggcugaaauagaaagggacguuaacgguaaggcgguagcaaaaaaggauauaucaggcaaagucauuuacaagcuagacaaagacggaaaaaaauuaccaagauuacaacaaggcgauacaauacgaggaucauuacaucaagacucaauauauggagccauaaaaaacccacuaaaaacagaggaaauacgauaugugaucagaaaagaccucgaauccaucaaagcuuccgaugucgauaauaucguagaugaaauggucaaggaaaaaguaaaagaggcuauagcaaguaaaguacugauacuguccucaaacccacagcaaaaaaacaaaauagacgggaaaguguggaugaacgaagaaaaaggaauuccaauaaacaaagucagacuguaugccaauagcguaaaaaacccauuagaaauaaaagaacacagcagccuaagcaaaaguagacacgagcauaaacaaaagguauacggacagaaugaugaaaacuucgcaauggcaaucuacgagggccuagauaaaaaagguaaaaccgaaagagcguuugaacuaauaaacuacauggaugcgggcuacuauuauaaacugaaaaacaaaaacgaaaggaaaaaagauauaauuucuuuaguucccgaaaaacacaucgaaaccggauucaaucuauuaagaagcaacaagauaccaauaauucuuaaaaaaggacuuaacguuauucuauauaaaaacgaaaaagaagaaauagacuuuaauaaucccaacaguauaauuaaaagauuauauaagaucagcggucuagacaaagacgggaucaaacuaauguauugcauaagugcaaaaggaucuacggaaaauauagcguauaugaacgacguaaucaauaaacaaaaacucuuugaauugaaaucggaaauggaaaaauuaggacuaugggacaaaguauuuucagacuucaaaaacgauaaccuaaaaaagagugacuucuucaaaaaacuuaaugaucuuuuaaacaaacauuauuuugagaacaauguaugcgacagcauuggaucaauaaaaaaagucaaaaucaaagaaucaggccucacgacaccaaaaggcggugauguaauugauaauuuuaaagauuuucccuauauaaaguucaaaguaaguaacuucaaugcacuaaucgaaggaauagacuuuaaaauaagcccaacaggaaaguuugugcagaucuga

SEQ ID NO: 9243 - RNA, 4587 nt, Artificial Sequence
  Cas9 variant
augaagaaaauuuuaggacuagacuuagggacuaauucaauaggcugggcacuuguagaacaagauuucaaaaauaaacaaggaaauauaauggguaugggaucaagagucauuccaaugucacaagaaauacuuggagaauuugcaagaggaaacacaaaaagcgaaaccgcagaacgaacgcgucuucggucaguccgaagacuucgagaaagacaccuucuaaggagagaaagacuacaucgaguacuacacauauuagguuuccuaccaaaacacuacguaaaccaaauagacuuccaagaaagacuuggcaaauuuuucgaagaaucagaaccaaaacuggcauacgauacuggggacuuccuauuuaaaccaucauucuuagaaauguuagaagaauuuaaaauccaccaaccuucauuuguagaaggagauaagaaaguaccauacgacuggacaauuuacuucuugaggaagaaagcacuuacagaaagaauagaaaaagaagaacuagcauggguaauccuaucuuucaaucagaaaagaggauacuaccaacugaggggagaagacgaagaagaaaaaccuaauaaacucgaagaauuuuacagucucaaaauagucgauauaaaaguagaugaaucaccaaauaagaaaggugacacaugguacucacuaaccuuagaaaauggauggauuuaccgaagaaguaguaaaguaccacuagacgacuggcugggcaaaacacgagauuucaucguuacaacggacauagaugaagaagguaacccaaaacuagauaaagaaggcaauccaaaacgaucauucagagcgcccucggaagaugacugggguuuacguaaaaagaaaacggaaaaagaaauacuagacuccagcaaaaccguaggucauuuuauauucgaaaaucuacuugcagacccuacacagaaaauuaaaggaaggcuaguaagaaccauugaaagaaaauuuuacaaagaugaacugaaacaaauauuaguaucacaaaacagauuccauccagaacucucagaugcugauaugauggcugacugcguuagggaacuauauaaacauaaucacagccaccaaaacuuuuuagcaaguaaagauauaaaacacuuauuaguagaugauauaauauucuaccaaagaccacuacgaagucaaaaaucaacuauaggaaauuguccacuggaauuuaaaacguucaagaaagacgguaucgaaauaaaagucccauauaaaguugcaccuaaaucacauccauuauuucaagaguucaggcuucugcaaugggugagcagucugagaauaauaaggaaaucagacgauucagaugugacgagggaguuccuggguacacaagauaaaacuaaacaauuacuggauuaccuaaugacucaaagcgaaauggauuguaacaaauuaaugacauuuuuacucacucaggaaggguacaaaagaaaagauuuaaaaagugaagucggaaaauucagauggaauuacguuuuugauucagaaacaggagaaaguaaaacauauccaggaaauuccacuagagcagaauuucuuaaaagacuggguaaaguggaagguuuugauuuuaguaaauauacagaagaguucgaagaaucuuuauggcauuuaguguauucagugacagauaaagucgaauuugaaaaagcccuaagaaaauuuagcaggaaaaaugguauugaaauaaauucauuugucgaaaaccucaagaaauuuccacccuacaaaucugaauaugcaucauacucuuuaaaagcuaucaagaaauuauuagcgcucaugagauucggggaaaauuggaaagaagacagcauagauagcauaucaaaacauagaaucgagaaaauacuaacaggagaauacgauccugaaauaaaagacaaagugagagaaauuucacgagcauucgacgaaguagaagauuuccaaggcuuaccaguuugguuugcaaacuacguaguuuauggacgacacucagaagcaagugaacuaauaaaauggacuucaagcgaugaaauggcugacuuuauaaaagaauuuaaacaacacucucuacgcaacccaauaguagaacagguaguucuagaaacacuuagaguaguaaaagacauaugggacaaauauggacauggacaaaaagacuuuuucgaugaaauacacguagaauuaggacgugaacuaaagaauccagcagaacaaagagcucgacugacaacccaaauaucagcaaaugaaaauacuaaucuaagaauaaaaucacucuugguagaacuauuacacgacccaggagucgaaaacguaagaccauacucuccaaugcagcaagaaaucuugaaaauuuaugaagaaggaguauuaaagaguucauucgaagugcccgacgacauacuaaaaauaaguaaaacugcacaaccuucaucaucagaccugaaaagauauaaacucuggcucgaacaaaaauacagaagcccguauaccgguaagauuauaccacuaaauaaacuuuuuacuccagcauacgaaguagaacauguuauaccucagaguagauauuucgacgauaguuuuucaaauaaggucauaugugaggcugcagucaacaaauuaaaagacaauagauuaggaauggaguucauaaagugcuuucauggccaacgagugagucuuggcuuuggagaagaagucgaaauauuuagugaaucagccuauaaggcguucauacaagauaacuuccccaaaaauccagccaagaaaagaaaacuccuuauggacgaacuaccugaacaaaugguagagagacaaaugaaugauaccagauacauaucgaaguucguaacuucaauacugagcaacauuguucgcagcgaagagaaugacaccggauuuaacagcaaaaauauaaucccugggaaugguaaaauaacgacagcacuaaagcaagauuggggauuaaacgauguauggaaugaauugauccuccccagguucgaacgaaugaaccaauugacagggacuaccguauuuacggcguggaaugaaaaccaucaaaaauucuuaccuacaguuccgcuagaauacgccaagggauuccagaagaaacggauagaccaucgacaccaugcaauggaugccuuagugauagcaugugccacaagagaucacguaaacuauuuaaauaaugaacaugccuuaggcaaaaauuacaaaggaaaagaagaaaaacaaucccgaagauucgaucuuaggcaaaaauuaugccucaagaagaaaaacggacauagccaagaacaauacgaauggauauucucgaaaccaugggauucauucacccaggaugcuaagaaaaaucuagaaagaauaauaguaaguuuuaaacaaaacuuacgaguuauuaacaaaaccaguaauaaauaucuuuccuauaaagaugaagaaggaaacuuaagguuagauucacaaggaaaaccagucaaagcauugacacgacagaucaaaggggacgcaugggccauaagaaaaucuauccauaaagacacuguaagcggacugguaaaauuacgaagagucaaaauggugaaucuaagugucgcuuuagauaauccagaaaacauacucaauaagaaacuaaagaagaaaauagcagaacucguuaaacuaaauuacgauaauaaauuauugcuaaaauacuuccgugacagagacuacauguucgauggacgugaaguauccaaacuugacguuuauuacuuugaagaaggcuuagcagccucccgcguuucauuagacacuucauuuagcgauaagaaaauccagaguauuacagauacaggaauaagaaaaauacuucuugcacauuuggcaaacuaccauggaaggcuugacgaaaaagguaagguuauaccgcccgaaacucuggcuuuuacucccgaaggaauagaagaacuaaauaagaauauuaaaggacuaaauggaggaaaauuccaucaaccaauauuuaagguccgcaccuaugaaccuaaagguaauaaauuucagguagguuucaaaggaaauaagaauaguaaauaugucgaagcugccaaaggaacaaaccuauucuuugcuauuuaccuaaacgacgaaggaaaacgaucguaugaaacuauaccauuuaauguagucauggaacgacucaagcaaggggaaggccccguuccacaaacgaaugaaaaaggcggaaaauuacuuuuucacuugucaccaaaugagcuaguguauguaccggaaaccgaugaaaauuauacuaacguugacuuuaagaaucucuccaaagaacaaguugagaaaauauacaaaaugguaucuaguacagggagugagugccauuucgucagagcggacauaucuagucucaucaaaggauaugacgcaaaaacaaaagucggggaauuagguucgcuuaacaaacaagaaguaacuaauaauggaaugacaagaauaaaagagaagugcuggaaaauuaaaaucgauagacuggguucgaucuga

SEQ ID NO: 9244 - RNA, 4587 nt, Artificial Sequence
  Cas9 variant
augaagaaaauauuaggaauugauuuggguaccaauaguauagggugggcagucgucaauaguuuugaugaaaaccaaaaugaagaauccuugaaacauauagaaugcguaggaagcagaaucauuccaauggacgcugcaauucuaggcgacuucgacaaaggcaauaguauaucccaaacagcaaagcguacagaguuuagguccguccgucaucuacgagaacgccacuuacuuagacgcgcacgacugcacaaaauacuaucccuauugggauuucuuccagaccauuauguccaggaucuugacagucaugguaauuuuccagucaacguagaaccaaaaauagccuggaggaaagacucaaauggagcauucgaauucauauucaacgauagcuuugacgaaauguuacaagacuuugcaaccuaccaacccgaacuuauugcuugcaacaaaaaaguacccuacgauuggaccauauauuaucuaagaaaaaaagcuuuaacaaagaaacugucgaaagaagaacuaucauggauauugcugaauuuuaaucaaaaaagagguuacuaccaguuaagaggagaagaagacgacgaaucgguaaaaagcgcaaaaaccagacaauacuuugauagacaaaaaauuaaaucaauuguagauacaaaccagacguauaaaggacaaaaaguacuaauaguagaacuagaagacggaauaaaggguaaaauauuuaaaaaggaaaucccaaacugggucggacaagaaaaaagcauaaucguuacaaucgacauagacaaagacggcugcgauaaauacgaagaaucaggugaacuaaguuguagauucaaaauacccucagaugcagaaugggaaucagaauggaaacucauaaaaaugaaaacacaaaaagaucuugacgcgucaggaaagacuguuggggcauacaucuacgacgcaauauuacagaacccgagccaaaaaauaagaggaaaguuaguuaggacaauagagagaaaguacuauaaagaagaauugaagcaaauucucaaaaaacaaguugaauuucauccggaacuaagggauaaagaucucuuucucgauugucuuaacgaauuauauccaaacaaugacgcucaucgaaacgcaugugcugauagagacuuuaucuaccuauucauggaugacauuuuauucuaccagcgaccuuuaaaaagcaaaaagucacucauugcagauugccccuaugaaaagcauauguaucgagauaaggaaacuggagaauuaaaauacagcucggucaaaugcaucgcaaaaucgcauccguuauuucaagaauuuagauuauggcauuuuauaucaaacaucaggaucuaucaaaaagaaagaguaguagauguagacgcugaucaaagugccuuaagcucagcacgaucagcgcuaaaaucaaaacucgaagcggacguagacguaaccaaugaauuuuugacuugugaagcugacuauguaagccucuuugagugguuaaacaauaaaaaauccguuucucaaaaagauuuucucaaguauccagcauucggaaucaaaaaaucaggagacaauuaucgcuggaauuauguagaagauaaaucuuauccauguaacgaaacaagagccuuaauacuuucacacuuagaaaaagccaacauucgcggugauauauucacaagggaacaagaagaagccuuauggcauauauuauacagcguggaagacagauacgaaaucgugaaagcauuacaaucuuuugcagcaaaauacagauuuaaugaugauuuuguaacggucuucuccaaguucccaccuuucaaaaaagaauacggcagcuacuccgcaaaagcuauaaaaaaacucuuaccucuaaugagaaugggcaaguauugguccgaggcugcuaucgauauaaaaacuagggaaagaauugaaaagauaaucaccggcgagugcgacgauucuaucagagaaagaguacgauugaaagcaauaagacuacacgacauuggugauuucagagcgcuuccaguaugguuagccugcuauguaguauaugaucgacauucagaaaguggugacauaacaaaguggaaaacuccucaagaaauggacugguacauacaaaacuucaaacaacacagccucagaaauccuauagucgaacaaguaaucacagaaacucucagaguggugagggauauauggaaacaaguuggcagaaucgaugaaauccacguagaacuggguagagaaaugaaaaauccagcagauaagcgagcuaaaaugacagcuagaaugauagaaaacgaaaacacaaaccugagaauuaaagcaaugcuaacugaauuuuuaaacccagaauuugaaaucgaaaaugugagaccuuacucugcaucacaacaggauauacuacgaauuuacgaaaacggaguacuaaauucaguaagugaaauaccugaagaaauaaccgguauuuuaaaaaaauuuaacgaaagagaacaaagaaaacgaccaucuacaagugaggucuugagauauaaacuuuggcuagaacaaaaauauagauccccuuacacagggaaaaugauuccacuaggaaaauuauucacaccagcguacgaaauagaacacauaaucccacaaagucgcuauuuugaugauucauucaacaacaaaguuauuugugaagcagaaguuaacaaacuaaaaggaaaucuacuaggguaugaauucauaaaaaaacaccacggacgcagaguagacuuaggacuaggagagauuguagauauuuucagcguagaugaauacgagacauucguaaaagacuacuauagugccaaccaacaaaagaugaaaaaauuacuuauggacgaaaucccugaacaauuuaucgaaagacaacugaacgacucucgcuauaucucaaagguuguuaaaucauuacuguccaacauuguuagagaacaagaugagcaagaaagcauaagcaaaaaucuaauagucuguaccgguggcguaacagaucgacuaaaaaaggacuggggaaucaacgaugucuggaacaaacuaauauuaccaagguuccaaagacugaauaacaucacugagacaacagaauuuacggcgaaaaacaugcaaggacacgaaauacccguugucccuuucgaauaccaaagaggauuuaauaaaaagagaauugaucaccgucaucacgccauggacgcgauaguuauagccugugcaggcagaaauauaguaaacuaucucaauaaugaaucagcacgaaaaaaagcccaaauuaguagguaugaccuccaaagacuacuaugugauaaagucaaaacugacgauaacggaaauuacaaauggauacuaaaaaaaccguggucuacucuaacacaagauguuuacgcggcccuagauaacgugauagucucuuucaaacaaaaucuaagagucauaaacaagaccaauaaccacuaugugcauuaugaagcaggaaaaaaaauaauagcaaaacaagaaaaagcaucaugggcaauaagaaaaccaaugcacaaagacaccguauucggugaaguuaaccuaagaaaggucaaaacuguuagccuuaacgaagcgauaaaaucgccccauuguaucguacagaaagauuucaaaaagaaauuacuaaguuuauuaaaacaaaacuucgaugcaaaggaaguaaaagcuuauuuugaagaacacaaggacguuuggagcgauauuaaccuaagcaagaucgaagucuauuauuuuaccaaagacacuaaagaaagauucuuugccacuagaaaaccucuggacaguucuuuugaucguaaaaaaauagaaagcguaacugacacgggaauacagaaaauucuacuaaggcacuuagaacaaaaaaauggagacucagaucuagcguucucaccagaugguauagaagaaaugaaucaaaacauuguacaauuaaacgguggucgaaaacaucaacccauaguuaaggugagaguguaugaaaaagccgauaaauucgcaauaggacaacaaggcaauaaagccaguaaauacguagaagcugcuaaagguaccaacuuauucuucgcaguguaugaagaagaaguuagggacaaaaagaccaacgcuguaauguucaagagaaauuaugccaguauuccuuuaaacguagcaauagacaggcagaaaaaaggcuuaaguacagcgcccgaagacgaaaauggaaacgcuccaauauucguucugucaccgaaugaucuaguauauuugccuacagccgaagauauaauaaaugcaagaaucaguuucccaauaaacaaaaauagaaucuacaaaaugguuucauguacaggauaucaaugcuucuucauaaaacaucacguagcaaacgucauaguggacaaaaaagaauucuccgccuuaaauaaaauggaaaaggcagagacuaacgaaaugauaaaagacauauguguacccauuaaauuagauagacuaggaaacauagucaaaauuggaguuuacaaauga

SEQ ID NO: 9245 - RNA, 4587 nt, Artificial Sequence
  Cas9 variant
augaaaaaaauccucggacuagacuuaggaacuaauucaauaggaugggccgucgugaacucauucgaugaaaaccaaaaugaagaaucguuaaaacacauagaaugcguaggaagcagaauaauacccauggacgcugcaauacuaggcgacuucgauaaaggaaacaguauaagucaaacugcuaagaggacugaauuuagaucaguccgucaucuaagagaaaggcaccuguuacgaagggcaagauuacacaaaauuuugucacuauuagguuucuuaccugaccauuacguucaagaucuugacucucaugggaauuuuccuguuaacguugaacccaaaauagcguggcguaaagauucaaauggagcauucgaguuuauauuuaacgacagcuuugacgagaugcuacaagauuuugcaaccuaucaacccgaauuaauagcaugcaacaaaaaaguaccuuaugauuggacaaucuacuaccuacguaaaaaagcgcucacaaaaaaacuuucaaaagaagaacuaagcuggaucuuauuaaauuucaaucaaaaaagaggauacuaccaauuaagaggagaagaggaugacgaaucuguuaagucagcaaaaacacgacaguacuuugacagacagaagaucaagaguauagucgauaccaaucaaacguacaaaggccaaaaaguauuaauaguagaacuagaagacggaauaaaaggaaaaaucuucaaaaaagaaaucccaaacuggguaggacaagaaaaaagcaucauaguuacaauagacaucgacaaagaugguugcgauaaauacgaagaaagcggagaauuaaguuguagauuuaaaauucccucugaugcagaaugggaaucugaauggaaauuaauaaaaaugaagacucaaaaggauuuggaugcaucaggcaagacaguaggagcauacauuuacgacgcuauacugcaaaaucccagccagaaaauaagaggaaaauugguuaggacaauagaaagaaaauauuacaaagaagaacuaaaacaaauacuaaaaaaacaaguugaauuccauccugaauuacgagacaaggaucucuuucuagauugccucaaugaacuauauccaaacaacgacgcacaccguaacgcaugcgcagaccgugauuucauauacuuauucauggacgauauccuauucuaccaacgcccucuuaaaucuaaaaaaucucuuauagcagauuguccguacgaaaaacauauguaucgagauaaagaaaccggagaacuaaaauacagcucaguaaaauguaucgcgaaaagucacccacuguuucaagaauuccguuuauggcauuuuauaucgaacauaagaaucuaucaaaaagaaagaguaguagauguagacgcaugucaaccugaucucucaucugcgcgaucggcucugaaaucaaaacuagaagcagauguagacguuacaaaugaauuucuaacaugugaggcagauuacguaucauuauuugaauggcucaauaacaaaaaaucuguuucucagaaagacuuucucaaguauccugccuucggcauaaaaaaauccggcgacaacuaucgauggaauuauguggaagacaagaguuauccaugcaaugaaaccagggcauuaauacuaagucaucucgaaaaggcgaacauaagaggagacauauuuaccagagaacaggaagaagcacuauggcacauccuauauuccguagaagacagguaugaaauaguuaaggcuuugcaaaguuuugcggcaaaauauagauuuaaugacgacuuuguaacgguauuuucaaaauuuccgccauucaaaaaggaauacggaucauauagcgcaaaagcaauuaagaaauuguuaccauuaaugcgaaugggaaaauacuggucagaggcugcaauugauauaaaaacccgagaaaggauagaaaaaaucauuaccggagaaugcgacgacaguauucgcgaacgcguaagauuaaaagcaauucgacugcaugauauaggagacuuucgagccuuaccggucuggcuagcuuguuacguaguauaugauaggcauucagaaucaggagacauaacaaaauggaaaaccccccaagaaauggacugguauauacaaaauuuuaaacaacacucacuucgaaauccuauaguugagcaaguaauaacagagacacugagaguaguaagggacauuuggaaacaaguagguagaauagacgaaauacauguagaacugggaagagagaugaagaacccugcagauaaaagagccaaaaugacggcucgcaugauugaaaaugaaaauacaaaccuuagaauaaaggcgaugcucaccgaauucuuaaaucccgaauuuaagauugaaaauguaagaccauacucagcaucucaacaagacauacuacgaauauaugaaaaugguguauugaacagugucucggaaauccccgaagaaauuacaggaaucuuaaaaaaauucaacgaaagagaacagcguaaaaggccaaguacuucagaaguacuaagauauaaauuaugguuggaacaaaaauacagaucgccauacacaggcaaaaugauaccccuggggaaacuauuuacacccgcauaugaaaucgaacauauaaucccgcaaaguagauacuucgacgauucguucaauaauaaaguuauaugcgaagcugaaguaaacaaauuaaaaggaaaucucuuaggguacgaguucauuaaaaaacaccauggacgaagaguugauuuaggucucggugagauaguagauauauucaguguugacgaguaugaaacauucguuaaagauuauuauagcgcaaaccaacaaaaaaugaaaaaacugcuaauggacgaaaucccggaacaauuuauagagagacaacuuaacgacucaagauacaucucaaaaguggucaaaucacuucuuuccaacaucguucgagagcaagacgaacaggaaucaauauccaaaaauuuaauuguauguacaggaggcguaacagacagauuaaaaaaagacugggguauaaacgaugucuggaauaaguugauacuaccgcgcuuucaaagauuaaauaauauaaccgaaacaacugaauucacugcaaaaaauaugcagggccacgaaauccccguaguaccauucgaauaucaacgaggauucaauaaaaaaagaaucgaccacaggcaucacgcaauggaugccauagucauugcuugcgccggacgcaauaucguaaacuaccuaaacaacgaguccgcaagaaaaaaagcacagauuucaagauacgaucuacaaagacuguugugugacaaaguaaagaccgacgacaacgguaauuacaaauggauacuuaaaaaacccugguccacucucacacaagacguauaugcagcacuagauaauguuaucgucagcuucaaacaaaaucuuagagucauuaacaagacgaauaaucauuacguacacuaugaagcaggaaaaaaaauaaucgcaaaacaagaaaaagcuucuugggcgauaagaaagccuaugcacaaagauaccguguuuggagaaguaaauuuaagaaaaguaaagacaguuagccucaacgaagcaauaaagucuccucacugcauaguccaaaaagauuucaagaaaaaauuacuaucacuauuaaaacaaaacuucgacgccaaagaaguaaaagcauacuuugaagaacauaaagacguauggucggacauaaauuuaaguaaaauagaaguauauuauuuuaccaaagauacgaaagaaagauuuuuugcaacaagaaaaccuuuagauucaucauucgacaggaaaaaaauugaaaguguuacugauaccgggauucagaaaauauuacuuagacacuuggaacaaaaaaacggagauagugaccuagcauuuucuccagauggaauagaagaaaugaaucaaaacauuguacagcuaaacgguggacgcaaacaccagccuaucgugaaaguaagagucuacgaaaaagcggacaaauuugcaauaggacaacaagguaacaaagccucuaaauacguagaagcagcaaaaggaaccaaccuauucuuugcaguauacgaagaagaaguacgugauaaaaagacuaacgcaguuauguucaagcgcaauuaugccuccauaccucuaaauguagcaauagaucgccaaaaaaaaggcuugucaacugcaccugaagacgaaaacgggaacgcaccgauauuuguauugagucccaaugaucuaguuuaucucccaacugcugaagauaucauuaacgcccgaauuucauucccgauaaacaaaaaccguauuuauaaaaugguuucaugcacaggauaccaguguuuuuucauaaaacaccacgucgcuaaugucauuguagauaaaaaagaguucagcgcauuaaacaaaauggaaaaagcagagacaaacgaaaugauaaaagacaucuguguaccaauaaaacucgaucgcuuaggaaauauagucaagauagguguuuacaaauga

SEQ ID NO: 9246 - RNA, 4590 nt, Artificial Sequence
  Cas9 variant
augaaaaaaauuuuaggcuuagacuuaggaacaaacucaaucggaugggcaguaguaaacucauucgaugaaaaucaaaaugaagaaagccuaaaacacauugaaugucuugguuccagaauaauccccauggaugcagcgauucugggagacuuugacaaaggaaauucaauaucucaaacagcaaaaagaaccgaauuuagggguguuaggcauuuaagagaaagacaucuacuaagacgugcacgucuccauaaaauacuaagacuauuaggauuccuaccagaccauuacguacaagaucuagacggacacggaaauuucuuaguaaaugucgaaccaaagauugcuuggcgaaaagauucuaacggcacauuugaauucaucuuuaaugacuccuuugacgaaauguuacaagacuuugcaaccuaccaaccugaauuaauagcaugcaaucgcaaagugcccuacgauuggacuauauauuaucuacgaaaaaaagcacugacaaaaaaacuaagcaaagaggaacuaucauggauacuauuaaauuucaaucaaaaaagaggauauuaucaacugcgcggagaagaagaugaugaaagcguaaaaacagcaaaaacaagacaauacuuugauagacaaaaaaucaaaucuaucgucgauacuaaucaaacuuauaaaggccaaaaaguacuaaucguugaguuagaagauggaguuaaaggaaagauauucaagaaagagauacccaauuggguugggcaagagaagucaaucaucguuaccguagacaucgauaaagauggaugugauaaauacgaagaaagcggagaguuaagcuguagguucaaaauaccaagugaugcagaaugggaauccgaauggaaauuaauaaaaaugaaaacacagaaagaucuagacgcuucaggaaaaacaguaggcgcuuauauauaugacgcaauacugcaaaauccaagucaaaaaaucagagggaaacuggucagaacaaucgaaagaaaauauuacaaagaggaauuaaaacaaauacuaaaaaaacaaguagaauuccaucccgaauuaagagacaaagaccucuuuuuagacugucuaaacgaauuauauccaaacaacgacgcacauagaaaugccugugcugauagagauuuuauauauuuguuuauggaugauauacuauuuuaucagaggccccuaaaaaguaaaaagucacucauugcugauugccccuaugaaaaacacauguauagagauaaagaaacaggagagcuaaaauauucgucugugaagugcaucgcaaagucucauccuuuguuccaagaauuccgauuauggcauuucauaucaaauauaagaauuuaucaaaaagaaagaguaauugauguugaugcaugccaaccugaccuaagcagugcuagaagcgcacuaaaaucaaaguuagaagcagauguagacguaacaaaugaauuucucacuugugaagcagacuacgugaguuuauucgaauggcuuaauaauaaaaaaucagucucacaaaaagacuuucucaaauaucccgcuuucggcaucaaaaaaaguggagauaauuaccgauggaacuauguagaagacaaaucauauccuugcaacgaaacucgagcguuaaucuuaagccacuuagagaaagcuaacauaagaggagacauauuuacaagggaacaagaagaagcuuuauggcauaucuuauauucgguagaagaccgauaugaaauagugaaagcacuacaaucauuugcagccaaauaccgauuuaacgacgauuucguaacgguauuuagcaaauucccaccauucaaaaaagaauaugguucguacagcgcuaaagcuauuaaaaaacuauuaccacuaaugagaaugggaaaguacugguccgaaagugcaauugacaucaaaacaagagagaggaucgaaaaaauaauuaccggggaaugcgaugauucaauacgagaaagagugcgacucaaagcaauacgacuccacgauaucgaacacuuuagagcgcuacccguaugguuagcaugcuauguaguuuaugacaggcacagugagucaggagacauuaugaaguggaaaaccccccaagaaauggauagcuacauccaaaauuucaaacaacacucauuacgcaacccaaucguagaacaaguuauaacagaaacauuacgggucgucagagauauauggaagcaaguaggacgaauagaugaaauacacguggaacuaggacgcgaaaugaaaaacccagcggauaaaagaaaggaaaugacaaaaagaaucaucgaaaaugaaaacaccaaucuuagaauuaaggccaugcuaacagaauuuuuaaacccagaauucgaaauagagaacguaagaccuuacucugcuucacaacaagauauucuuagaaucuaugagaacggaguacuaaacucuguaagugaaaucccagaagaaaucacugggauauuaaaaaaauuuaaugagcgugaacaacggaaacggccaucaacaagugaagugcugcguuacaaguuauggcucgaacaaaaauauuguaguccauauacuggaaagaugauaccacuaggaaaacuauuuacgccugccuaugaaauagagcacguuaucccacagucgagauacuucgacgacucguuuaauaacaaaguaauaugugaagccgaaguuaauaaauuaaaaggaaaucuucuugguuacgaauucauaaagaaacaccauggccagcgagucgaucucggucucggggaaauaguagacauauucucgguagacgaauaugaaacuuucguaaaagauuauuauuccggaaaccagcaaaaaaugaaaaaauuacuaauggacgaaauaccagaacaauuuaucgaacgacaacugaacgauaguagauauauaucaaaaguugucaaaucauuacuaaguaacauaguacgcgaacaagacgagcaagagaguauaaguaaaaacguuauuguauguacagguggaguaacagaucgacuaaaaaaagacugggguaucaacgacguuuggaacaagcuuauucugccgagauuccaacgccucaauaauaucacagaaacaacugaauucacagccaaaaacauggaaggccacgaaauuccaguagugcccuucgaauaucagagggguuucaacaaaaaaagaauagaccauaggcaccacgcaauggaugcaauuguaauagcuugugcgucaaggaacauagugaauuaccuaaauaacgaaucagcuagaaaaaaagcaagaauaucuagauaugacuuacaaaaacuacuaugugauaaaguucguacagacgacaauggaaauuauaaauggauacuaaaaaaaccaugggguacguugacccaagauguauaugcugcucuggauaacguaauuguuagcuuuaagcagaauuugagaguaauaaacaaaaccaaaaacuauuacguccacuacgaagcaggaaaaaaaacaauugcaaaacaagaaaaaggcagcucuugggcgaucagaaagcccaugcacaaagacacaguauucggagaaguuaauuugcgaaaaguaaaaaccguaagccucaaugaagcaauuaaaaacccccaauguaucgucgaaaaagauuucaagaaaaaacuccuaucacuccuuaaacaaaacuuugacgcaaaaaaaguaaaggcauauuucgaagaacauaaagacguauggucugacauaaaucuuagcaaaauagaggucuacuauuucaccaaagauacaaaagaaagauuuuucgcuacgagaaaaccacucgauucaaguuucgacaagaaagaaauagaauccguuacggauaccgggauucaaaaaaucuuacucagacaccuagaacaaaaaaacggagauccagacuuagcauucucuccugacgguaucgaagaaaugaaccauaauauagugcaguuaaacggcggcagaaaacaucaaccaauuguaaaaguaagaguauacgaaaaagcggauaaauucgcaauaggccagcaaggaaacaaaucaucgaaguacguugaagccgcaaaaggcacaaaccuguucuucgccguauaugaagaagaaguuagagauaaaaaaacaaaugcaguaaugcuaaagcgucacuacgcaucaaucccccuaaauguagcaaucgaucgacaaaaaaaaggacucaguaccgcaccggaagaugaaaauggaaauguaccgauuuucguacuaucucccaacgacuuggucuaccuuccaacagcugaagacaucgcuaacgcaucaauuagcuuuccaauaaauaaaaaucgcaucuauaaaaugguaucauguacugguaacagguguuucuucauaaaacaucauguagcaaacguuauaguagauaaaagugaauucucuguauuaaacaaaaucgaaaaagcugagacagacgaaaugauaaaggaaauaugugugcccauaaagauagaucgauuagguaacauugugaaaauagguguauauaaguga

SEQ ID NO: 9247 - RNA, 4608 nt, Artificial Sequence
  Cas9 variant
augaacacgauacuaggacuagaucuagguacuaacucgauaggcugggcccuaaucaaaguacuaaacgauaaaacccgacuuccacuagaaaucauagauuugggcguaguaguaauccccaccgaucaacgaacacuagacaaauucuccaaaggugaaagcauuaguaaaacagcagaaagaacgaaacaaaaaggcguuagaaaacuauacgaaaggaagaaauuaagaagagaaagauuacaccguguacucaacauucuaggcuuucuaccagaacacuacucgaagaaaauugacuuuaagaaacaucuaggacaauucuuuggcaacucacaaccaaaaauaagcuauguagaaaacgaucacggaaaacaugaguucauauucauggauuccuauagagaaauguuaaaagaauuuagcaaacacaacauuaaaaacgucccauaugauuggacaauauauuacuuaaggaaaaaggcuuuaucccagaaaauaucaaaagaagaauuagccugggucauacuaaauuuuaacaagaaaagagguuacuaucaauuuagggaugacaacgcagaugaaaacaaagaaaauaaaauagaaaaauauuaugcacuuaaaguaacuaaugucaagaaagaagaugcacaaaauuauaccauaacacuggaaaauggauggaucuauaaaaacaaaaguaaaauuagcuuacuagauugggucgguucaacaaaagaguucaucucaacggaaaaauucgacaacaaagguaauauaaucaaaaagaaaaacggagaagaugauagaacacuaaaauuaguggauagcgaaaaagacuggauagcaauuaaaaaguccaccgaagacagaauagaaaauuauggcaaaaccguaggaacauaccuauacgaacaccuacuaaaagacccaaaccaaaaacuuaauggugaacuaauuaauauaauugacagaaaauucuacaaaaacgaacuuaaacaaauauuggaaaaacaaaaagaauuucaccccgaacuccucaacgaagacuuauuccagaaaucaauaauagaacuauaucccaaaaacuccacgaggcagaaagaacucaaaaauaaagaccucugcuacuugcuuauugacgacgucaucuauuaccaaagagaccucaaaaagaaaaauucgacuauaaauaaaugcagcuucgaaucucgcgaauauuaccucaauggagaaaaacagauacagaaaauaaacugcauugcaaaaagcaagccacuauaccaagaauuucguacccuccaauucaucaaaaauuuaaaaguguacgaaauaauugacggccuagaaaaagacauaacaaguaaacuccucccggacuucgaaaccaaagaacacuucuucgaaugguugaaugacaaagagaaaauagaucaacuacaacuccuuagcuauaaguguuucgaccuacaugacaauguaaagaaugaucuaaucgcaaaaggaauaaagcgaccuaccgaaaaagcaauacgcacagaacuacuagaaaaauacagauggaacuacagcaaagacaacgacagaaauuuccuacuaaacgaaacgagauucaaaauuuuaaaauaccuaaagaaaguagauaagaaauugacuuuaacgaacgaacaaauagaaucccuauggcucuuacuauauuccgccaaagacgaacgugaauugaaaaacggacuucaaaaauucucagagaaaaacaaacucccuaagaaauucuccgauauuuucauaucauucccaccauucaagaaagaauacggagcauacagcgaaaaagcacuaaagaaacuguuaucccuaguucguuucggaaaauacuggagcuuuaacaaaauugauaacaauauccaaaauaaaauaaugaacauacuaaacggcgaaguagacgacucgauaucagaccgaguaagagagaaaacaauacuauuacaggacaaaaaugacuuccaagaucuaccuuuaugguuagcaucuuacguagcauacaaccgcuucagcgaggucagcgaaaucaaauacugggauagcccugauaaaauagaguuccucaaacaacacucaaucgguaacccaauaguugagaaaauaauaaacgaaacccuuaaacuaaucaaagacauuuggguuauacauggcaaauccugcaaaaacuucuuuuccgaaauccacauugaacugagcagagaaauaaaaucuaguagcaagaaacgagcucagaucaccaacaauaauaccaaaaaccaaaaacucaacaaucuuaucaaaucccugcuuauagaaauggcaucugauacaaaguaugaaaauguaacaccauacuccccaucacaacaagaaauacuaaaaaucuaugacgaaggaauauauucaaaagaagagaacucagagaaaauaaaagaaauaaauaaaauaagaaacaacaauaaaaucucaaaaucagacauaacuaaauacaaacuuuggcuugaacaaggcuauauuuccccuuacacugggaagauaauaccacuaaccaaacuauucacagccaaauaccaaaaagaacauauaauaccucaaacaaaauucuuugacgacagcuucaacaauaaaguuauaugugaagccgaaguaaauaaacuaaaagauaauucccucgccaugaacuuuaucaaagccaaaggcggaaaagcuguaaaacuauccgacggcgaaacuguaacaauccuaaaccaggaagaauacaaacaauuaguaagaaccucauuuaagaaaaauucaaucaaacuacgaaaucuacuuuuagaagaaauaccagauacauucacgaaaagacaacuuaacgacacaaaauauauaucgaaacucguacuuucgcuauuaucgaacauaguaagagaaaaaggugaacucgaaucaacagcuaaacgaaucgugucaacuaacggccaaaucacaagcauccucagaaacgauuggggccuaaacaacauauggaauaaacucauaacuccacgauucgaaagacuuaauaauauaaacaaaaacaaaauauaugguaauugggaaaacaagaaagguaaaaacguauuucaaauaaacuaccucaaugacaauuuaagcacacuaaauacuaaacgcauagaucauagacaccacgcacuugaugcucuaaucgucgccuguacuacacgaaaucacauaaauuuccuaaacaaucaauaugcaaaaucccguaaucaacgacaugacuuaagagcaaaacuaaaaagaagagaaacaauaacaacagaagguagcaagaaacaagucuuuaaagauuucauaaaaccuugggaauccuucacucaggaugcacuuaagaaacuugaaacgacgauaguaaacuuuaaaguaaacaaacgaaucauaaacaaaacaauaaacugguacaagaaaugggaaaaacaaaaagacggaacuuauaagaaaauacagaagaaacaaaccaaaggagaugcaugggcgaucagaaaaccauuacacauagauaccauauacggaaucgucugcaagaaacucccccucaaaucagcacuagagaauuauaaaaacauaaucgacgaaaaccuuaaacacaaaauaaaagaacuaaaagaagucaacaaauuugauaacaaccaaaucaucaauuucuuuaaagaguguaacuucaucuucgaagauaacaacauucaaaaaguagaaguauacgacuucaaagauaacagagauaaaacaauacucucaucaagccgacaacucauagaugaaucauuuacaccuaagaaaauaggcaaaguccuagacccaacaaucaggaacauauuacugaaacaccuaaacucuacaaaauauaacaauaaauucgauucggauggcaaccccauaaaacccgaaaaauuagccuuuucuccagaagggcuaaaagaccucaacaaaaauauaaagcacuuaaauaauaauaaggaacaucaaccaauuaagagagucaaacuuuucgaaacccucggcaacaaaauuaaaguaggguacacacaacagaaaaauaaaaaguuugccgaaacggcuacaggaacuaacuuauuccucggaauuuauuccgacaauaacaaacgagauuucaaaaccauaccccuaauucucgcaauccaaagagaaaaagaaggacuaaacccaugucccgauacugacgaaaagggaaaccaacuguuauuuucacuuucgcccaacgaauuggucuuuguuccuaauaacgaagaacgcaaaaacccuaaccuaguagacuuugaaaaucucucaaaagaccaaauagacagaauauauaaauucguaucuuguaccggaagugaggcuuauuucgugccaucaagaacugcaaaaccaauaauagaaaacgaaaacggcaccaacaacaaaucacaacgaauaaucgaguucaaugagaaaaccucaauaaagaacgagaagaacgaacccguacuaaucaaaacgaucugcuggaaaauagaaguaaacagacuggguaaaauaauaaaaguaaucaaauga

SEQ ID NO: 9248 - RNA, 4608 nt, Artificial Sequence
  Cas9 variant
augacaaaaauauuaggauuggaucuugguacuaauucaauaggaugggcgauaagagauacagaaaaugaaggcauaaaucaaaucuuggacaaaggagcccggaucuuuagugaaggaguuaaaucagagaaugguaaagaaauaucaagagcugccgaaagaaccgcuuauagaucagcacgaaaaauaaaauacagaagaaaacucagaaaauacgaaacauugaaaguacuaaguaucaaugguaugugcccacuaucugucgaagaggucgaacaauggaaaaaguccggauucaaagaauauccucucaacccagaguuucuagacuggcucaggaccaaugaagacaaaaacauuaauccuuaucuauucagagauaaagccaguaaacaaaaagucacauuauuugaacucggacgagcacuauaucacauagcacaacgaagaggguuccuaucuaacagacuagaccaaagcgcagaaggaguuuuugaagaacacaacccgcaaauccagaauuuaauagaagaccucgacucaaguaacacgauacucaacgagcugaaagaauauuacaucaaccuagguauaauugaugaaaccgaaaaaucaggauucaaaaaagacuuagaugaaggugaaaaaaaguuaaaaucacuguacaauucacuugucgcgauaacaaagaagaacgcaaaugacauagagacuuguaagcaggaauuaauagcaagauugaauaaaaaggaagaccuagguaaggugaaaggaaaaauaaaagacauaucacaagcaauguuggauagaaauuucaagacauuaggacaauauuucuucucccucuacaauaaagaaagaauucgaaaccaauacaccucccgagaagaacacuauuuagaagaauucauaaucauaugucagacacaaggcauagaaggaaucaacaccaacgaaaaacucccagaaaagaaauucacgggucuugcaaaagaccuauauagggcuaucuucuuccaacgcccgcuaaaaucacaaaaagguuugauaggaaaauguucguuugaaaagaauaagucaagaugcgcaguaucacacccggauuacgaagaauucaggauguggucuuaccuaaauacaauaaaaauaggaacccaaucagaaaaaacacucagauuuuuaacacuugaggaaaagcugaaauugguaccuaaguuuuaccgaaaaucagacuuuaauuuugaaguuuuagcuaaagaauuggucgaaaaaggagcuuccuucggguacuacaaaagcucuaaaaaaaacgaguuuuucuacugguuuaauuacaaaccaacagauuccguaagugcaugcguaguaucagcgucgcuugaaaaugcuauagguaaggacuggaaaauaaaaacauucgaauaccaaacucguaauacugaaaaaaaugaagucacaaaaaguguagauuauaaggaucuuuggcaccuccuaaguguagcuacuucagauacuuacuuauaugauuucgcaaucgagaaauuaaaauuagaaccuaaaaacgcaaaagcauuuaguaaaacuaagcuaaaaaaagacuucgcaagcuuaucccuugcugcuauagccaaaauucuaccuuaccuaaaacaaggauuacuauauucacacgccguauucauggcaaauauugagaacauaguagacgcggacauauggaaagaugaggaacaacaaaaauucauacaaucaaagauaguagaacuaguagauaacuauauagucgaaaaaagcaaauuagaacucaucaacggacuauuaaaaauuuacaauacagaagauaaagaaggaagaaaaguauauuacagcaaagaagcugagucacuauucgaagcugacuuaagaaaaaagcucgucccauuuuacaaagccaauauaauaauugaagaacacgaacaggaaauaauauuucaagaccuauucccaauacuaauggaucaauuaaagaagcaagaguucauaaaaauugguaggcuugacaaacaaauugaagcauuuuuggagggugaaaacgaggagggucaaaucuuuugcaaccacacugauaaauugaaaaaacuuuaccacccuagcgacauagaagucuucaaaaaaaaaacaauaaaggacgaauggggaaaugaaaagguagucuuaggcucaccgcuaacuacaucaauaaaaaauccaauggccaugagagcauuacaucaacuucguaaaguacuaaacaccuuaauugccaacgaccagaucgacgaagauacaaggauacacauugagauggcacgagaacuaaaugacgcaaacaaaagaaaagguauacaggacuuccagaacgagaacaaaaaauucagagaagaagccauaaaagaaauaaaaaaacucuauuuagaagaaugccauaaagacgugaacccaacagaggacgacauacuaagauaccaacuauggcucgaacaagggaaaugcgaaauauacgaagaaggaaacaacaucucaauaugugauauuauuggcaguaacccauccuacgauauagagcacacgaucccgcgaaguauuucacaagacaacucccagaugaacaaaacccuuuguagccuuaaauuuaauagaucaaucaaaaaacaaaaaaugccaguagagcucucaaauuauaaugacauacuaccacgaaucgcacauuggaaaaaagaagcagaagaauuaacacgccaaauagaaacuauaaguaggucuauuaaaucggcagcaacaaaaguagcaaaagauaaaaacaucagaaaacgacacuauuuaacauuaaaacgagauuauauccuuggaaaauaugagagguucaccugggaagaacccaaagucgguuuuaaaaauucccaaaucccugacaccggaauuaucacaaaauaugcccaagcauacuuaaaaagcuacuucaaaagaguugaaucagucaaaggaggcgcaguagccgaauuucgcaaacuuuggggaauccaagaaucuuuuauugaugaaaacugguggaagcacuauaaagacaaggaucgugauaaacacacccaucacacuauagacgcaauaacuauagccuguaugccuaaagauaaauacgaucuacuagcacaugcauggagauuagaagacgaacaagacaaaaaagcggcuaaaguccuaaucgaacaggcaaaacccuggaagacauuuaaagaagauauagagaaaaucgagacagaaauacuuguaucucacuuuacaccagacaacgucaaaaaacaaagcaaauccauaauaaaaaaucgcggaaaaaaaguauauguacuuaaaaacgaacucccaguuaauuuuaagaauaaaauagaaggaaaagauuacuucaaacuaaaauuugauucaaaaauccuauacaaaaucccaaaaaaaaaggaaaaacaaacagacacuuucuacgaggaacuuccgaaaaauuauuugaauggaguugaaggaaaagauuacuuuaaaaucaauaccaccggcaaaaccuuuuacaaaauaccuauauucaaucaaggagauacuauaagagguucacuccaucaagaaacgacauacggagcuauaaaguuacccgauaucgacauagaaacuaaaaagccauuacacacggacaaagguggcuuuauccucaaaaaagauauaaaagggaacgaaaucguuuuuuucgucguacgaaaagaaauaagcaaaaucucagaaaacgacguucaaaacauugucgauaacguagugagaaaaaaaauagaaaaugcaauagcaaacucgcuaauuacauucaaaauuguaaagaaaaaaaaaguagcaguaauuaaagaaggcguaacaaucuggaugagagagccaaauaucgaaaaaggaauagaagguauaccaauaaaaaaagucagaaucauaacaaacagugugaaaaauccuaucgaaauaaaaguacauaguccauuaucaaaaucacgucauaagcauaagcaaaaaguauauggacaaaacgacgaaaauuaugcgauggcucuauacgaacucgacggaaaaagggaauucgaauuaauaaacaauuuuaaucuagcuaaacuccugaagcaaucccaauccuacuacccucuucacaaggaaaaagaaauuaaaggaaaaaaaauacucguaccuauagaaaaacgcaacaauaaagauguaauacuaaaaagaggacaacaaguaguauucuacgauaaaaccguugaaaauccaaaggauaucagugaaaucauagauuuccgagaacgaauauauauuauugaaggccuaacaauacaacggcaaaaagacaaaaaaacuuccaaaguuaacgaauacggaauuauacaacuaagacacuucaaagaagcaagaaaaucagaagaaaucucuaaagacaauuuuaaaccugauggagaauuuaagauaaaugaaaacaaaccaacaagaaaaaugaaccacaaccaguucacugccuuuguggaaggaauagauuucaaaguacuaccuuccggaaaauuccaaaagauauga

SEQ ID NO: 9249 - RNA, 4614 nt, Artificial Sequence
  Cas9 variant
augaagaaaauccucggccucgaucugggcaccaacuccauagguugggcauuaacaacuaacgauuucgauacuaagaaaggaacaauugaagguuuaggauccagaaucauacccaugagucaagacauacucggaaaauucgauucagggguuucauuaucacaaacagcacaacguacagaauaccggggcaaacgacgccuaguacaacgauuccuuuuaagaagggaacgucuucauaggguacuacacaucuuagaacucuuaccaaaacaauauagugaagcuaucgauuuugauaagaaauuaggacaauucaaaccagaacgugaacagaaaauuagcuuuuacaaaaaugaaagcggcaaaaaucaauucauauucacgaaaucacaccaagaaaugcuaacagaguuccaaacauauuauccaacgaucaaaaauauuccauaugacuggacuaucuacuaccuaaggaagaaagcgcuaacagagaaaaucaguaaagaagaacuagccuggauucuauuaaacuucaaccagaaaagaggcuacuaucaacuaagaggagaagaaaaagaagaaaauaaaaauaagaaagaagaguuccacacacuauuggugacagacaucaucgaacgcgauaaaggcaaaucaggcacaugguauaacguaauacuagaaaacggauggauauacaaaagagaaucaaaaauuagccucgcagauuggauaggcaaaacaaaaucauucauaguaaccacagaauauaaugaugacggaagcguuaaauuaacaaaagacaaugaagaaaaacguagcuuccgauccccaaaagaagaugacuggggauugauuaaaauaagaacugagaaaacaauaaaucaaucagauaaaucuguaggagcauauauuuaugacgcauuacucaaaaacccaaaucagaaaauaaaaggagaauuagugagaaccauagaaaggaaauauuauaaagacgaacuuagagaaauacuaaagaaacaauuagaauuucauucagauguacucaacgauaaaauacucuacaagaaauguaucgacgaacuauacaaaaauaacgauucgcauaaaaacaguaucaaagaucguggcuucgauuaucuauuccuagacgacauaauauucuaccaaagaccacuaaaaucaaaaacgaguuuaauuagcgauugcagucucgaguuccgcccuaucaaaaacaaaaacgggguauuagucaaagacacagacggaaaacaaauagccaaagcccuaaaauguauagcacgaagcaauccaauauuccaagaauuuagauuacuacaauucguuaaaaaucugaaaauauacaaaaggggcgucguagaugacguagaaguaaccaacgacuaucuuaaaagugaaaacgauguggaaaaacuauucaacuggcuaaacgauaaagcagaaaucaaccaaaaacaauuucuaguaaacuuuaaacugaaagaagacaaacauagauggaacuucguagaagacaaaggcuaucccuguaacgaaacacggaaucaauuccuuaaugcaauugcaaaaauugauguagacaaaucauucuuuaauaccaaaaauacucaagaccuauggcacauacucuacagcgugacagauaaaauagaaauaacgaaagcaauaacaaccuuugcaaaaaggcauaaucuacccaaugaauuuaucauaaacuucaguaaaauaaaaccauauaagaaagaauaugguucauucucagaaaaagcaaucaagaaacuacuaccuuuaaugagguucgguucguacugggaugccaaaaacauagauauaaaaacucuggaccgcauagacaaaauccaaacaggagaauuugacgagaaaauuagaaacagaguuagagaaaaagcaauagaccuacauaaaaucgacgauuucaaagauuuaccuuuaugguuagcaucauacauaguuuaugacaaacauagugaggcuucagauguaagcaaauggaaaacucccgccgacauagaaaaauucuugaaacaugaguucaaacaacauagucugaggaacccuaucgucgaacaaguuauuacagaaacucuacgugucguuaaagauauuuggcuccaauacggagaaggaaaagaaaauuucuucaaugaaauucauauagaacuaggaagagaaaugaaaaaugacaaagcgacacgcgagaaaauaucaaagaaaguguccgaaaaugaaaacacaaaucucagaauuaaagcgauacuuacagaacucaaaaacgacggagucucagauaucagacccuacucaccgucacaacaggaaauacuaaaaauuuacgaagaagggguguauaacaacgaaucaagaaaagaaaaacucgaagaaguugauaaaauaaggaaaaaugcuaaacccaccaccucagaaauaauaaaauacaaacuuugguuagaacaaggguacgccagcccauauacuggaaaacuaauucccaugucugaauuauuuacaacuaaauaucagauagaacacauuauaccgcaaucccgauucuuugaugacagcuuaucuaacaaaguaaucugcgaaucagaaguaaacgagcuuaaaucaaacaugacagcauuagaguucauucugacgaaugaaaaucgaauaguuacauuaacaggaggagaaacugugaaaauauucaccaaagaggcuuacaaucaacauauuauaucauauuauucaaagaauaaaaacaaacaaaaacgguuauuaaccgaagaaauacccgaacaauuuauaucuaggcaauuaaacgacacaaaauauauaucaaagaucgucaaaaacuuacuuucgaaaauaguaagagaggaagacgaacaagaaguuacgagcaaacacguuguaucgcuaaacggauccauaacaucuagaaugaaacaagauugggggcugaacgauguuuggaacacaaucgucagcccacgcuucgaaagacuaaacacguuaacaaauagcaaugacuucgggcaauuugaacuuaagaaagacgcuuacggaaaugaaggcaaacgugucuuucaaaccacaguaccagaugccauugcaaaaggauuuacgaagaaaagaauagaucauagacaccaugcgcuugaugcucuaguaauagcaugcguaaacagaacgcacauaaacuacuuaaacaaucuaaaugccaaagauacugaugacaaagccguuaaacaugaacuccgaaacaaacuauguuucaaaaccaaaccagacucaaacggaaacuacaaaugggaguuccacaaaccaugggaaaaauucaccaaagaagcacaagacaaacuaaauacgacaauaguaucguuuaaacaaaacacccgaguaauuaauaaaacuguaaauaaauacguuuccuauaaggaugaaaauggaaaccuuaauguugacgcuaauggacuaccccagaagaaaguaaucacgcaaacuaaaggagauaauugggcaauaagaaaaccccuccaugcagaaacaguaucaggaaaaguauuuuuaaaaagaauuaaacaaucccauauaacaaucgccaacgcaauugaacaggucgaacucauugucgauaaagaaguuaagaaacaacuuaaagccaaaauaaaacuuuauccaaacaacauagcaggacuaaagaaacaccuaaaagccuuucccguaaugauaaaugauaaagcaauugauaaaauacaaaucuaugaaacauuagaagccacugcgacgcgaaaaauauuggacauaacguucgaugagaagaaaauacagaaaauuacagauacaggcauacagaaaauucuacuaaaucacuuaaaacaagaaaaguaccaaaauacaguugacgaaaacggaaagaaacuagcaccccacgaaauagccuucagcgaaaacggucuagaagauuuaaauaaaaauauaacuuuccuaaacgaugguaaaaaccaucaaccaauaaagaaaguaagaauuuucgaagaaggaaauaaguucccucucggagaagugggcaauaagauaaauaaauuugucgaaacagcaaaaggaacaaauuuauucuuugccguauacgaaaacgacgacaagaaacgaaauuacaagacaaucccauucaaugaggucauagaaaggcaaaaacagggacugaaugcagcacuagaaaucgacgaaaaugguaauagacuccuauuuacccuaucaccaaacgaucuaguuuauauaccacuagaagacgaaauuggguaucuuaacggaguuuauuucaaaaaccuaaacaaagaacagacaguacgcauauacaaguucgucucauguacaggaggugaaggucacuucgucccaaacaauuacucaaaagaaaucauuagcaacgaaaacggcagcaauaacaaaaacgaacguaugcucaauuucaauaauuuuaauauaauuuucgauggaaaagaaaaaccgguaaugauaaaaagcaucugcuggaaacuagaaguagaccggcuuggaaaagugaucaaaaucaucaaauga

SEQ ID NO: 9250 - RNA, 4617 nt, Artificial Sequence
  Cas9 variant
augaaacauauacuaggcuuagauuuggguacaaacucuaucggcugggcauuggucaaaagcgagcaagacugugaugacguagagagaauaaauggaauagaagcagcuggaagcagaauuauaccaauggacgcagcgguauuaggagacuucgcaaaaggaaacaccaaaucacaaaccgcagacagaacagcugcacgaggaauacgaagaaugggcgaaaggcacaaacucagaagggagagauuaaaucguguucucgacguaauggguuuucuaccggaacauuauagcgcagcguuaacgagguaugggaaguucaaagacggugaggaauguaaaauagcauggcgaaaggacgaaucgggccaauggacauuugucuuugaggacucguucagagaaaugcuugcagauuucguugcacaucaaccugaauggcuagcaggaggaaggaaaguaccauacgacuggacaauauacuacuuaagaaagaaagcacucaguaaaccacuaacaaaacaagaacucgcauggcuccucuuaaacuuuaaucaaaaacgagguuacuaucaacuuagaggagaagaugagcauacagacgacaaaggaaaauuaguagaauauuaugcauuaaaaguagucgguguugaagacacgggugauaagaaagguaaagacacaugguucaauauaaugcucgaaaauggaaugguuuauagacgaccggcugcagaagcgccugacuggauuggaaaaacuaaagaauuuauaguaacuacugacuuggaaaaagauggaacaccaaagaaagacaaagaaggaaacauaaaaagaucuuuuagaaugccuaaagaggacgauuggacacuaauuaaaaagaaaaccgaaaacgauaucgacagaucaggcaaaacaguuggagaauauauuuacgaugcccuucuagcagauccaacgcagaaaauaagaggaaaauuaguccgcacuguagaaagaaaauauuacaaagaagaauuaaagaaaauaauuaauucccagaaaagguucauaccagaauuaaaugacaaugaauuguauggacgcugcauuucugaguuauaucagagcaacgacgcauacagacaaagcauaucgaguugugauuucacauaccuauucgucgacaacauuauauuuuaucaacgaccucuaaaaucaaagaaaagucucauugauaauuguccguaugaagaacauucuuauacagauucaaaaaccggugaagucaaaacagcuccugucaaaugcgucgcaaaaucaaauccuuuauuucaagaauuuagauuauggcaauuugugcagaauauaagaaucuucgagagacagaaaaagauaggagauagcguaaaaacugacgucgacguaacaggugaguucauaaaaucugcagacgacguaguuucauuauuugauuuucuuaaugacagaaaagacauuacacaaucuguacucuugggaacauacuuuaaaaucaagaaaccaaaaggaaaagacagugacuauccuuacagauggaacuauguugaagauaaaacuuauccaugcaaugaaacucgugcacugauauuaaagggccuaaaagacgcuggaauagaugaaggguuuuuagauaaagacaaggaauauagucuguggcauauacuauacucaguggaagacaaacaagaaauuacaaaagcgauggaaaaauuugcagccaaaaauagucuagguggaaaauuugcagaaguauucuccucacuaccuccauucaauaaaaauuauggaucauacagugaaaaagcaauaaagaagcugcuggcacuaaugagaacaggcaaauacuggucagcagaugcaauagauaaacacacgcuagaaagaaucgauaagauuauaaauggcgaauaugaugaaucaauaaggacaagaguuagagaaaaagcuauaaaucuaacagacgucucucacuuccgaggacuaccgcuaugguuagcauguuacauuguauaugauaggcacucggaaucaaaagacauuacaugcuggaacuguccagcagacauagaucaauaucuagaccacuuuaaacaacacucauuaagaaauccuaucguagaacaaguaguaaccgaaacguuaagaacuguacgcgacaucuggagacaauauggaaaaauagacgaaauacacauagaaaugggcagggacaugaaaaacccagcugauguacgagccaaaaugucgaaaagaaugauagauaaugaaaaugcuaaucucagaauaaaagcaaugcucgcagaguucgcagacccagacuucggaaucgcagggguucgaccauacaguccaagccaacaagaaaugcugcgaaucuacgaagaaggagcguuagaaucuguagacgaggucccugaugaaauuaaugaaauaaucucaaaauuuaaccaaacugauauaaagaaacgaccaacgcauggugaaauaauaaaauauaaauuauggcuugaacaaaaauaccaaagucccuauacaggcagaacgauuagcuuguccagauuauuuacggacgacuaucagauugaacauguaauaccucaaucuagauacuuugacgauuccaugucaaauaaaguaauuugugaagcagaaguaaaccaacuuaaagauagaaugcucggauaugaguucauaaaagcacaucauggcgaaaagguauuauuaucgucgggugaaacagugacaauauugacagcagaagaauacgaaagauuagugcaacucaacuucaggaagaacccaguuaaaaugaagaaguuacuaauggacgacauaccagauaaauuuauugaaaggcaauuaaaugauucaagauacauaaguaagaaaauaaagagcuuacuauccaacaugguccgggacgaaggagaacaagaagacaucagcaaaaacguaauagcauguaacggagcaaucacagacagacuaaaaagagauuggggaguaaacgauguguggaaccacauuaucuuaccacgauucgaaagacuaaaugcaguaacuggaagcgacagauucacuacaacaucgacaaacggacauacaauccccgauaugccacucaaccuucaaaaagguuuuaauaagaaacgaaucgaucacaggcaucaugcaauggaugccaucguaauagcaugcacaaccaggucccacgucaacuuacuaaauaaugaagcugccaugagcaaaaacaaugcuguacgcuaucaacucucaagaaaacugcgacgauacgaagauacaaugguaaccagaaauggagaaacaagaacaaucagcguagcacgagaguucuugaaaccauggccaacauucaaugcagaugucgaaaaagcacuaaggggaaucgucgugucauucaaacagaauuuacguguuauaaauaaaaccgucaauaaauaccaaaaauucguauauaaugaggaaaaacauauaaaagagaagaaagcaguaagacaagaagaaagaaauggaagacacuuacuagcaauaaggaaaccuaugcacaaagauaccguguacggagaaguaaaccuccgaagaaucaaagagguaaguuuaaaggacgcuguagccaacccaaaagcagucguagacaaagaucucaaaaagaaauuaauggcaaugauagaauuaggauaugacuugaaacaaauaaccaaauacuuugaagauaacaaagaugcauggcaggacgugaaccugaaaaagauaaaaguauacuacuuuacgaaagacacaggagauagauauuuugcaacuagauuuggaaacgaucuaguaacacuauuuaguaaaaucacaaaagccgacgacgcuaagaaacaaauagaacggauuacagacaccgguauucagaaaauucuaaaacgacauuuagaggcuaacggcggugauugucaaaaagcauucucggcggacggcauugacgagaugaacaggaauauuacacaacuaaacggcggaagaccacauaaaccaguauauaaaguaagaauauaugagaaagccgauaaguuugcaauagggacuaagggaaauaaagcagcaaaauuuguagaggcagccaagggaacaaacuuauucuuugcagucuauuugaaagaauacgaagauaguacgacgggggagaccauuaagaaaaggguuuuugacacuaucccacuaaaaacaguaaucgauaggcuuaaaaacgggcaaacuccagccccagaggaaaaagacggagcaaaacuacuauucguucuaucacccaacgaucuaguauaucugccaacggaggauguaguuaaaaauggaacaauaaauagaccauuagacaaacgucgaauuuauaaaaugguaaguuguacaggaacagaauguuacuacauacccuuuauaguggcaagcccuauagucgacaaaguggaauuuuucagccuaaauaaaauagggagagcgauuacaggagagaugaucaaagaaauaugcauaccaauaaaaguagauagauuaggaaacauaacugagguaaauaaugagaaaaucuga

SEQ ID NO: 9251 - RNA, 4623 nt, Artificial Sequence
  Cas9 variant
augaacaaaauacuuggacucgaccuaggaacaaacucaauaggaugggcuuuaguagguacagaugaagaaggaaauccaauacgaauauauaaaagcgguaguagaauaauaccuaugucacaagacgugcucgggaacuuugaccggggaaauaguauaucacagacagccgaaagaacgagcuauagaggaguaagacgacucagagaaagacacuuacugagaagagaacgacuacacagaguuuuacaccuaaugggguuccuaccuucucauuaugaagaagcaauagguugggauaaaggagacaacaaaacauuugcaaaauuuuauucggauacagaaccaaaacucccuuggaggaaaaacgccgaaagagaacaugaguuucuauuuaacacacccuauaacgaaauguuaguagacuuucgcaaaaaccaaccacaacucuucaaaaucaagaaaaacggacaagaauccuuaauaccauacgauuggacgauauacuaccuaagaaagaaagcauuaucaaaaccaauaucuaagaaagaauuagcauggauaauacuuaacuucaaucaaaaacgagguuauuaucaauuacgaggggaggaagaggaggaaaauucaaauaaauuaauagaauaccaugcucuuacaguagucaaagucauagcggacgaaccacaaaaaggaaaaagugacauaugguacaacgcagaacuagaaaauggaugggucuacagaagaucaagcaaaaccccgcuauucgauugggagucuaaagugaaagaguucguagucacaacggacuugaaugcagacggaaguuuaaaaguagauaaagaaggcgguguuaaaagaucauucagaguaccauccgaagacgacuggaugcuugucaaaaagaaaacggaaucagauauagagaaaucagauaaaaccguaggauguuacauauacgacacaauucuccaaaaccccucccagaaaauaagggggaaacuuguacguacgauagaacguaaauuuuauaagaaagaacugacugaaauacuaaauaaacaaaaagaauuucacagugaacuacaaaauaaagaacuauaucaagaauguauaaaagaacuguacccacauaaugaagcucacuacgacucacuauuagucaaagacuauacagauuuauucguaaacgauaucauauucuaucaacgcccccuaaaaaguaagaaaucguuaauaucaaacugccccuaugaauauagagucuauagaaaugacucuggaauuguagaaagaguucccauaaaauguauagcuaaaagccacccgcuuuaucaagaauuuagauuauggcaauucauacacaaucuaagaauauaugagagacaaagagaagucaauggcaaaccggaaacagaugucgauauaacagcagaauuuaucccaacuacagaagacaggguuaaauuauucgauuggcugaacaauaagaaagaaauaaaacaagauacacuccuucaaagcuacuuuaaaaucaaaaagaagaaaggagacgauaaauucccauauagauggaacuauguugaggacaaagaauacccuugcaaugaaacaagggcauuaauacucucgaggcuaacaaaacucaacuuaucagaagacuuucuaacuaaagaaauggaacuagcauuauggcacauacucuauuccgucgaagacaaagaagaaaucaaaaaggcuuuuaaaaguuuugcacaaaaacauaaccuagaugacagcuuuguagaucaauucauaaaauuuccuccuuucaagaaagauuacggcagcuacagugccaaagcaaucaagaaacuacuaccuuuaaugagaauaggcaaauauugggacgaaaaagccauuagcggaaauaccagaucuagaauacuaucuaucaaugaaagauuggaggauaugcggaguagcggcaagaaaauugaagacguauccgaugacgacauaccaaaacaaguuuuaaaaucauucgacaaaguaaacggaguauacagcggauuaaacacauaccaagcaugcuacgcaguauauggaagacauagcgaagcaagcgaaauaacaaaauggaaaacaccucaagacaucgacgauuaccuaaaugaauuuaaacaacacucacugagaaacccuaucguagaacaaguaauaacagaaacacuaagaguuguuagagacauauggaagaaauacggagauuucuccgaaauucacauagaauuaggaagagaaaugaaaaauccagcagauaaaagagcgaaaaugacaacacaaaucucggaaaaugaaaacaccaaccugagaaugaaaagucuguuagcagaacuaaagaaccauaaugauguagaaaaugucagaccauacagccccagucaacaagaaauacuaaaaauuuacgaagaaggaguauuaaauucaguuucugaaauaccagaagagauuauuaaaaucacuaaaagcagucaaccaagucaaacagagcuugucagauacaaauuauggcuugaacaaaaauaucgauccccauauacaggugaaaucauccccuugggaaaauuauuuaccagcgcuuaugaaauagaacauguaaucccacaaucccgcuacuucgacgauucauuaucuaacaaagugauaugugaaagugaaguaaauaaauuaaaaggaaacuuauuaggauaugaauuugucaagaaucaucauggugucaaaguagaacucaauuuuaauaagacagucgaaauauucucaauaaaugaauacgaggaauuuguuaaaggaaacuacggcaaaaaccgaggcaaaaugaagaaauuauuauuagaggacauccccaagucauuuauagaaagacaacuuaaugacacaagauauaucucaaaggugguaaaaggacucuugagcaauauaguccgggaagacggugaacaagaggcuacuuccaagcauguuauaccuugcacaggcggcguaaccaccauauugaagcaagauugggguuugaacgacguauggaacaaaauaguaaccccaagauuugaaagaaugaacgaacuaaccaacacaucuuuauucggacagugggaaaacaaggaaggaaagaggauuuuuagaacggagguaccuuuagaacuucaaaaaggauuuaauaagaaacgaauugaccaucgccaucaugccauggacgccauaguaauagccugcgcaacgaggucccacgugacauaucuaaacaacgaaucgucaaaggcaaacgcgaaagaaaucagagauggauuaaaacauaaacucugcuuuaagucuaaaacugaugaaacaggaaauuauaaauggcaguuucauaaaccaugggacacauuuacacaggacguacaagauacauuagaaaacauagugauaucauucaaacaaaauuuaagaguaauaaauaaaacuacuaaccgauaccaaaaauaugaagaggagaagaaaauucuaaaaucacaagaaaaaggagauuccugggcgauuagaaaaccacuacauaaagacaccguuuucgccaaaguauccuuacagaaaauaaaaugcgugaaacuagccauggcacuuaaagauuggaaaaacaucguagauaaacaauugaagaaagaaauuaggaggcuaauucuaucauacggaaaauucgacgcugaaauacuaaacaaauauuucaaagacagaaaguacauauuuaaagauguagauauaaguaagguagaugucuacuauuucgaaacagaauauguggcaacaaggaagaaucuagacacuuccuucgauaggaaaaguauagaaagcaucacggauacggguauacaaaagauauuacuaaaucacuuaggagugaaaaacaauaacccagaacuagcuuuuucggcagaagguauugacgaaaugaaccaaagaaucguagaacucaacggcggcaaacaacaccaacccauuuauaaaguacguauguaugaaccccuggguaauaaauuccaaguaggcaggaucgggaacaagaaagauaaauacguugaggcugccccugguacuaaucucuuuuaugcuaucuaucaaagcgaagauaagaaaagaaucuacgacacaaucccacuuaacauaauuaucgaaagacagaagaaagaauuauucccuguuccagaaaacaaagaagauaaagauaauuuauauaagcugcuauucugguuaucaccaaacgacauggucuaucuacccaccgaaaaggaaugggccaauccagaucuuuuuaacuucaacaauaugaccaaaaaccaaagaaagaaacucuacaaauucaucgacggcucaggaaccacagcgaacuucauacccaacaccguagcaaacaucauauucaguauacccaagaaagacucaggcaaauacaguaugggaaauagaauagugcagaacgaauuuggaauugggagcccccaaucuaaaaaccaaaaggcuuucacaggggagaugauaaaagaaagaugcuggaaacuaaaaauaaaccgucuuggugacauaauagaaugcauaaaauga

SEQ ID NO: 9252 - RNA, 4629 nt, Artificial Sequence
  Cas9 variant
auggaaaaacgaauucuuggacuagacuuaggaacuaauucaauuggaugggcauuaguaaagggagaaaggcaugaaaaugacaaugaaacaauccuuaguuauauugaagccgcaggaaguagaauauuaccacucgaugcagcagcacaaggggacuuugagaaaggaaacccagcuaaaacacaaacuucagaacggacacgaaugagagguaugagacaccuacuagaaagaagccuccuaagacgagaaagacuucacagaguucuagacauaauggauuuuuuaccgccacacuacagccaaagcuugacaagauacgggaaauucaaagcagacaccgaaugcaaacucgcauggcgaaaaacagagacuggucacuaugaguucuuauuucaagacaguuuccaagaaaugcuucaagauuuucaaaaccacgggaaguuagaagaaaacaaaaaaaucccuuaugacuggacgauauauuaucugagaaaaaaggcucuaacgcaaccaguuuccaaacaagaacucgcuuggauccuacuaaacuuuaaucaaaaacggggguacuaccaaagagaagaccaagcaguagacgauaaccaaaaaaaaagaguagaauaucaagcacugaaggucaucaguguagaagacacaggagaaaaaaaaggcaaaaacacgugguacgacguucgauuagagaauggauuaguauaucauuauucagcacccauuaagccggacuggaaaggggaaacuaaagaauucauagucacaacaacuauagaccaaaauggcaaaccugaauuggauaaagaugggaaaccaaaauauucaaugcgcgccccuaaagaagacgauuacaaauuacuuauggaaaaaacaaaaaaagauauaacugauaguggaaaaaguguuggugaauauaucuaugaugcgcuauugguaaauccacaacaaaaaaucagggguggguuaguaagaacuauugagagauauuucuauaaaaaagaacuagaaaagauacuacucucacaagagagauuuauucccgaacuaaccgaccgagaauuguauagaagaugcgucgaggaacuuuauccaucgaaugaugcuuaucgacauuuaauagaaucaagagacaugagguacuuacuagucgaagauauccuuuuuuaccaaagaccucuuaaaaguaaaaaaagucuuauagaugauugucccuacgaaaguagaagcuaugucgauagagaaacaggagaaauaaaaaguucgccaguaaaauguauagcacaaagucauccccuauuccaagaauuuagauuauggcaauucauacacaaccuuagaauauaccaaaaugagagaucaguagaaggcaaauuacaacuugauguagaugucacggaagaaguacugccaacaccagaaagcaaagcagcucuauuuagauuccuaaaugaucgagaaaauguuacgcaagaaauacuccuaaaagaaguauuuaaggggagaaaauuaucagugaaagauugcccuuauagauggaacuacgccggagaaggaaaaaaauaucccuguaacgaaacaagacacuuaauguuaaaauuauugaaaaaagccggaauagauacagcguuucuaacaccugaaaaagaacaagcgcuuuggcacauaauguauucgguugaagacaaagaucaauacgaaaaagcuuuaucgacauuugccagaaagaaugaccugcccgauggcuuuaaagaacaauucaaaaaggcuccaacauucaaaaaagacuauggggccuacucauuaagagcaauuaaaaaauuauuaccgcuaaugagaguaggagaauacuggagugcagacugcauugacagcgagacuaaggaaaggauuucacaaauaaucagaggugagauggaugaaaaagucucucaacgaaugacuaaaucgagagacuccuucaccgauauuagucaauuccaaggauugcccguuuggcaagcuuguuacguaguauacggaagacauagcgaggccacagaaauacagcgcugggaaaaaccagaagauaucgacgucuauuuaaaagcuuuuaaacaacacucucuacgaaacccuauuguugagcaaguuguacucgaaacucugcgagucguuagagauauuuggaaaacguacgguaaaguagaugaaauucauauagaaaugggaagggauaugaaaaacaccgcagaagaaagaaaaagaauauucaauagaaaucaacaaaaugaaaaugauaaccuacgaauaaaagcauuacuaacggaauucaugaacccugacuuugaaauagaaggaguuagacccuauucaccaagucaacaggaagcuuuacgcauuuacgaagacggagcuugguccggacuugaugaagaaaaagaagauaaaaaagaacuagaagcaauuagagagauccuagguaaauucucgcaaucagacaaggcgaaaagaccgacacacagugaaguauugagauauaaagcguggcuagagcaaagauacagcucacccuauacuggugaggccauaccucuugcuaaacuuuuuacaccagcuuacgaaauagaacacguaauuccucaaucaagauucuucgacgauagcuucucaaacaaagucguaugugaagcagaaguaaacaaauugaaagacagaauguuaggcuaugaauucauaaaagcucaucaaggagaagugguaagucuuagcggaacagggagaugcgcgagaauauugucgccagaagaguaugagcaaagggucaccgacuguuacaaacauaacacugccaagaugaaaaagcuauugauggaagagauaccagacgacuucauacaaagacaaaugaacgacucacgauacaucagcaaacugguaaaaucgcuacuaagcaauaugguacgagaagagggugaacgagaagcaauaagcaaacaugugauuacuugcaacggcacgauuacugauagacuaaaaaaggacuggggggucaacgauguauggaaucacaucauauuaccaagauuccaaagaaugaaagaccuaacugggagaaacgauuuuguagcaguaaauucacaaggucaugaaauuccuucaguaccaccugagcuccaaaaggguuuuaaaaagaaaagaauagaucauagacaucacgcuauggacgcgauagugauagcaugcacaacuagaaaucauguaaaucugcuaaauaacgaagcggcuaugagugaaaauaaagcaaauagaauugccuuaagcaggaaacugagaagauacgaaaauugcgcaauuuauaaaggaggagaaacaaagaauauaagcguagcgaaagaguuuuuaaaaccgugggccacguuuccagcagauguggaaagggcacuaggagacauuguaguaagcuuuaagcaaaauuuacggguuauaaacaaagccacaaaccauuacgaacauuacaaagacgggaagaaaguuaaaguaccgcaaaaaaaaggagacauguggguaguccgaaagccacugcauaaagauaccguauaugcacuagucaaucuacggaauguaaaaacaguuggguuaaaagacgcaauacuuaugccagauagaauugccaacaaagacuuaaaaaaaaaaguuaaagaacuacucgcucaaggugacgaccuaaagaaaauaaaaaaauauuuugaaacagaaaaagauacauggcaagauguagacguaaaaaagaucgaaguauacuauuucagcgaagagacugcaaaccacuauuaugcaacgagaaagcccuuugaugcgaacguaaaaaucgacagcguaacugacacuggaauucaaaaaauacuccgaagacaccuagaagaaaauggaaacaaagcagacguagcauuuucgcccgaaggaaucgcacguaugaaugaaaauauauuccgccuuaauggaaauaaacaucaccaaccuauauacaaaguaagaguuuacgagaaagcgaauaaauaccccguagggcaaaccggcaauaaagcaucuaaguucguugaagcggccaaggguacaaaccuauacuuggcaguauaugaaagugaaguaguagacaaaaagaccgcagagauaucaaaaaaaagaaguuacguaaucgugccauugagagaugcuguugcacgucaaaaacaaggagugccgguugcgccagaaagaaaugaagaaggcgggaaacuucuauuuguauuaucucccaaagacuuuguauauguacccacagaagaagaaaggucaaaaggagaaguacugcuaccauuagauaaaaauagaauauauauaaugauggaugcuucagacgguauugucaauuuuuuaccauacucaguagcaaauuuaauauacgcacuuccgaaagaccaagcaucaggauucugcacagaugguaggaugauacaaaaugaguuuggacuagggucuccaaaaucuaaaaaugaacgagcuuuaacaggagaaaugauaaaagaaauuugcuuaccaguaaagguagauagacuagggcguauaaccgagaucaaugggaacaagguauga

SEQ ID NO: 9253 - RNA, 4644 nt, Artificial Sequence
  Cas9 variant
augaagaaaauacuaggauuagauuuagguacaaacucgauuggaugggcauuaacuaacaaugacuuugacaauaaacuaggaaguauagaaggacuaggauccagaauaauaccgaugagccaagauguucucggaaaauucgacuccgguguaucaauaagccaaacagcagaaaggacaaaauacaggggaacaagaagguuaguccaacgauucuuauugagacgcgaaagauuacacaggauucuaaauauauuagacuuucuuccacgacauuauucggaagcaauugauuucgauaagaaauucggucaauucaaaccagaaagagaagaaaaacuaaguuuuuauaaaaaugaaucaggcaaaaaccaauuuuuauuucuagaaucgcaccaagaaauguuuagugaguucaaacuaacacacccagaccugaaacaaguuccguacgacuggacaauauauuauuuaagaaagaaagcucucacccagaaaauaaguaaagaagaacuggcauggauaauacuaaacuucaaccagaaaagaggauacuaccaauugcgaggagaagaagaagaaguaaacaaaaauaaacuagaagaauuucacacccucguaaucguugacguaauagaacgugaaaaagggaaauccgguguaugguauaacguaauccuugaaaauggauggauauauaaaagagaauccaaaauagcacuguuugauuggauuggaaaacagaaaaauuuuauaguaacaacagaauuaaaugacgacggaacaauaaaauuaaacaaagauaaugaagagaaaagaucauuuaggucaccaaaagaagacgauuggggacucagaaaaauccggaccgaacaaacaauaaaucaaucagaaaaauccguagguucauuuaucuacgacgaacuacuaaagaaaccaaaccagaaaaucaaaggagaauuaguacgaaccauagaaagaaaauuuuacaaagacgaacucuccaaaauccuaaaagcgcaaauaacauuucauuaugaaauucucggagauagaaauauuuacaagaaauguaucgacgaacuauaccgacacaaugacagucacaaaaauaauaucaaagauaaaggauucgacuauuuauuccuagacgauauaaucuuuuaccaaagaccauuaaaaagcaaaacaucgcuuauaagcgacugcucuuuagaauuuguaccaaucaaagacaagaaaggaauccuaguuaaagacucaaacgguaaacaaguaguaaaaccacuaaaaugcauagcaaaaaguaacccaauauuucaagaauuuagacucuugcaauucgucaaaaauuuaaaaauauauaagaaagaaauaaucaacgaaauagauguaacuaaugacuaccugaaaacagaagaagacuuaguagaacuauucgacugguuaaacgauaaagcugaaauuucacaaaaacaauuucuagccuauccaaaauucaagcuaaaggaagacaaauacagauggaacuucguagaagacaaaauauacccguguaaugaaaccagaaaccaauuucuuaaugcgaucgcaaaaaucgacgugaauaaaucguuuuucgaugccaaaaacacccaagacuuauggcacauacuuuacucuguaacagacaaaacugaacuauuuagcauaaauaccgaaacuggaauacaauccggcgcauugagcacauucgcaaaaagacauaaccuauccaacgaguucguuucuaauuucucaaagauaaaaccuuacaauaaggacuauggcucuuauucagaaaaagcuaucaagaaacuccuuccccuaaugcgauuuggcaguaacuggaauaaaaacaauauagacgcaaaaacacuagcuagaauagacaaauugcaaacaggagaguuugaugagaccaugagaacaagaguaagagagaaagcaauacaccuaucaaagauaaccgauuuucaagggcuaccuuuauggcucgcaucuuacauuauauaugaccgacauagcgaggcaucaaauaucagcaaauggaagaccccggaagacauagcgugguuccuaaaccccaaaaacaaaucaggguuuaaacaacacuccuuaagaaaccccauuguggaacaaguaauaacagaaacccuccgaguuguaaaggacauauggcaacacuacggugaaggaaaagaaaauuucuuuaacgagauacauauagagcuaggcagagaaaugaaaaacaacgcaaaugacagaaaaagaauaacggaaacaauaaaucaaaacgaaaacacaaauuuacgaauaaaggcuauacucacagaacucaaaaacgauggaauaaacgaugugcgaccauacucaccaagucaacaagaaauacuaaaaauuuacgaagagggcguauacaauucagaaauacgaaaagaaaaguuggaagacauagauaaaauaagaaagaacgcuaaaccaaccccuucugaaauaauuaaauacaaauuauggcucgagcaaggcuauauaucaccauauacagggaaacuaaucccacucagugauuuauucacgacaaaauaccaaauagaacacauaauuccccaaagucgccuguucgacgauagucuuuccaacaaaguaauaugugagagcgaaguaaacgauuuaaaaggcaacaauacugcgcuagaguucauacuaaagaaugaaggaagaaucguacuuuuaacgggagguaaaacaguaaaaauuuuuacuaaagaagcauauaaucaacauauaacaagcuacuauaucaaaaauaaaucuaaacagaaaagguugcuuacagaagaaauaccugagaaauucaucgacaggcaauuaaaugauacaaaauacaucuccaaaauagucaaaaaucuauuaucaaagauaguaagagaagaagacgaacaggaaguaacauccaaacauaucgucucauugaacgguagcauuacaagucgaaugaaacaagauuggggucucaaugauguguggaacaaaaucguaagucccagauuugaaagacucaaugcaauuacaaauaguaacgacuuuggaaaacuggaacucaagaaagaugaguucgggaacgcggggaaacaaguauuucaaacaaccguaccagaugauauugcaaaaggauucucaaagaaaagaaucgaucacagacaucacgcauuagacgccuugguaaucgcuuguaucaauagaacacauaucaauuacuugaacaacuuaaacgccaaagaugagaacgauaaaacuaucaagcacgaacucaggaacaaacuauguuucaaaacaaaaccagauucuaacggaaauaguaagugggaauuucacaaacccugggaaaacuucaccaagaaaguugaagacgaacugaaccaaacaauaaucaguuucaaacaaaacacaagggucauaaacaaaaccgugaacaaguaucaaguauggaaagaagaagacggagcaaugaagaaaguaaccgucaaacagacaaaaggagacaacugggcaauaagaaaacccauacaugccgaaacaguaagcggcaaaguauuucuaaaaagaaucaagcaaucacauauaacgauagcaaaugcuauugaacagauugaguuaauaguugauaaagaaguuagaaaacaguuaaaggccaaaauaaaacaauauccaaacaacaaagaagguuuuaaaaagcauuuaaaagcguuuccaauuaugaucaauggaaaagcuauagauaaaguacaaauauacgaaacaauagaagcaacagccacaagagagagaaauaaucucgauauuacauuugaugaaaagaaaaucgagaaaauaaccgacaccgguauacagaaaauauuacuaaaucaccuuaaacaagaaauauaccaaaaugcuaucgacgaaucuggcaagaaaauagcuccacacgaaguagcguucagcgagauuggcauagacgaacuaaauaaaaacauaaaaguguuaaacaaugguaaaaaucaucagcccaucaagaaagucagaauuuucgaagaaucgaagagauuuaguuuaggacagucgggaucaaagacagacaaauauguagaaacugcaaaaggaacaaacuuauuuuacgcgauauacgaaggaaagaaaggaaauagaaauuauaaaacuauaccguuaaaugaaguaaucgaacgacaaaaacaagggcuaaauucagcauuagucacugacgagaaugaaaaccggcuacuuuucacucucucaccaaacgaccuuguuuauauaccaacgaaugaagagaagaaaaacuuaacaacaaucaauuucgauaaacuguccagagaacaaacagaaagaaucuauaaauuugucagcugcacaagcggugaaggacacuucguaucaaauaauuacucaaaagaaauuaucucuaaugagaaugggucaaauaacaagaacgaaagaaugcucgaauuuaauaacucgaauacaauuuacgacgaaaaggaaaaaccaguaaugauuaagagcgucugcuggaaacuagaaguagaucgacuagggaagaucaaaagaauaauucgguga

SEQ ID NO: 9254 - RNA, 4677 nt, Artificial Sequence
  Cas9 variant
augaagaaaauucuuggauuagaccuuggaacuaauucuauaggaugggcacucgucaacgucgacaaaaauggaaauccguucggaaucgaaggacuagggaguagaauuauaccaauggaccaagccacccuauccgauuuugaaaaaggaaacuccaaaucacaaacagcagaacguaccauguuuagaggagcaagacggcuaagagaaaggaaacaucuacgaagagaaagacuacaucgaauacuaaaugaguuaaacuuccuaccaauccacuauagaucauguauagauuuuguacaucgauuggguaaauucaaagcaaaucacgaaccgaaaauagcauggcgaaguaacgaccaagauaaaauggaauuuaucuuucagaacucauuucuugaaaugaugucagacuucacuaaaaggcaaccugagcucguaaaagagggaaagaaaauuccuuaugauuggacgauuuacuuccuccggaagaaagcacuaggccaaagaauagaaaaagaggaguuagcaugguuacuacuccacuucaaucaaaaacgaggauacuaucaauuacgaggagaagaugaaauugaugcaacuaggagugcaaaaacgaggaaauauuuugauagaaaaauaaucaaaaguauaauugacaccggagaagaauacaaaggccuaaaaguacucauaguagagcuagacaacggaaaccaaggaaaaauauuuaaacaggaaguacccgacuggguaggacaagaaaagaacauuauugcuacuguagaccucgauaaagacgggaaagaucgauuugacaagggagucuuaagccaacgauucucaauaccaucugauagcgagugggaaacugaguggaaacucauaaaguuaaaaaccgaagaagacuuagaagccagucagaaaacagucgggaccuacauuuacgacucacuacuaaagaacccaaaccaaaagauaaagggaaaauuaguucgaaccauugaaagaaaguauuacagagacgaauugcgagcaauccuuaauaaacaacgugaguuccauccagaacuuaaugacaaaaaguuauaucaacauuguauuuucucacuuuacccccaaaacgaagcauuuagaaacucaauagcaaacaaagauuucacuuauuuauuccuagaagacauaauauucuaucaacggccgcuaaaaucuaagaaaucaacaauaaauaacugugccuacgaaguaagacgauauauggacaaagaaaccaaagaacuuaaagaaguccccuuaaaaugcauugccaaaucacacccgauauuucaagaauuuagauuauggcaauucauaucaaaccuuagaauauauaagaaagauaucacagauauagacgucacaaaugauuuccuccauagccaagacgauuaugcgaacuuauuugaaugguuaaacaacaaaaacgaaauugaucagaaagcauuuuuaaaauauccagcuuucggcuucaagaaagaugcaguaaauuaccgauggaauuacguugaagacaagaguuauccauguaauaaaacucgcucagcuauacuaaguaaacuugacaaacacgaacaagaauuucuaacuaaagaacucgaauugaaaauuuggcaacuucuauauucugucaacuccaaagaagaaauagacaaagcauuaaauguaaacucucccaaaauuaacaauaaaauaucuauagaccauaccggcauacuucaugagcuaaaaagcuccucgcucucugacaucaguauccaaagacucaaggcgauaaacuuugaagaaaaggacuacggcucuuauuccuauaaagccauaaagaaacuacuugcccuuaugcgacaaggaaaauacuucgauaauaccgcaauuacagacgcuacaaaagcaaggauaaauagcaucuuugacagacuugaaucgauaucguuugacccagaacguauaaacucaauaagugaugaugacauacccaaacaaaucuuaaaauccuucauaaaacucaacagaacguacggagguuuuaacacauaucaagcaugcuacgcagucuacgguaggcacucugaagcaaaagagauagcgaaaugggaaaaacccgaagauauagaucaguaucucgcaaaauucaaacaacacaguuuacgcaaucccauugucgaacaaaucaucacagaaacucuaagagucguuagagacaucuggaagaaacaugcuuauaaaaccauaaacaaagauaaccaaggaaacaacugcgaaucagaaucugagcuaacagaaauacacauagaacuaggcagagauaugaagaacaauaaaagugaacgacuaagaauaucgagaauaaacagcgagaaugaaaacacaaaucuaagaauuagaaaacuucuaauugaguucaaugacccugaauuuggaguagaaaacguaagaccgcauucaccuucacaacaagaaaucuugcgcauauaugaagacggagucuuaaagaguggaguugaaauacccgaauacguagauaauauaauaaagaaauuuaaagaaacagacguaaagaaacaaccuucaaaaucagaagucuuaagauauaaauuaugguuagaacagaaauaucggucaccauacacuaacgaaguuaucccccuuggcaaacuguuuacaaacgacuaccaaauugaacauauaauaccccaaucccgcuauuucgacgacuccuucucaaacaaaguaaucugugaagccgaaguuaaccaauuaaaagaaaaugagcuaggcugugaauuuauaaugaacaacggaggaaggauaguagaacuaucuuuugguaaaacuguuagaauauuggauuuugaagcauacgaacaauucguacaacaaaacuacgcaggaaaucgaccaaaauuaagaaauuuauuaaugacggaaauuccaaaugauuucauagaucgacagcuaaacgacucacgauacauaucaaaaguaguaaaaggauuacuaucuaacauugucagagaagacggugaagcugaaucuacaucgaagaaucugauaucuugcacuggaggaguaacggcaagauugaaaauggauuggggccuaaaugauguuuggaacaaucuuauuuauccaagauucgaaagacucaaugaacuaaccaauucgaaucaauuuggauauugggauaagaaagacgguaaaaacgucuuccagacacaaguucccauggacauccaaaaaggauucaauaagaaacggauagaccaucgucaucacgcauuggaugcuuuaguaaucgcaugcgcaacacguagccauauaaacuaucugaauaacgaaucugccaaaucuaacucuaaagaaucgcgauaugaucuaaggagaaaauuacgaagacuagagguaauacaaaaagaauacacuauaaauggaaggaaggaaauaagaaauauagaaguagcuaaagaauuuuauaagcccuggaacagcuucacucaagaugcacaaagcgcacuagaaaauaucguggugucauuuaaacaaaaccuccggguaauaaacaagacaacaaauuacuucuuacgauucaauaaggaagggaaaaagauauucgaaacacaaacaagcggaagcaacugggcaauaagaaaaccauuacacaaagacaccgccuucggacucgucaaucuaaaacgaacaaagacaguaucccucgcaaaugccauauuggauuacgaccagauuguuaaucgaaaacuauggaccaaaaucaaagaauugauaucuauaggcuaugacaacaaacggauucuaaaauauuucacugaugauaaggaaaacuggaacgaaauaauaucgucaggcauagaagucuuuuacuacaccgauaauuucgaaaaacagguagcaacaagaaagccacuagauacuagcuuuacagaaucaaaaaucauaaacucaauaacagaccucggcauucacaaaauacuacuggcucaccucagggcaaaugagggaaacccaaacaucgcauuuaguccagaaggcauagaaaccaugaaccgucauauaugugaauuaaacggcgguaaauuccaccacccuaucuauaaaguacgaguacaugaaccccuggguuacaaguuuaaaguaggagacaaggguaaucgcucaacaaaauauguagaagcggcuaaaggaacuaaucuauucuuuggcaucuauauaaacucccaaggaauaagaagcuaugaaacuauaccacucaauguggcgauagaaagacaaaaacaagggcuuucgccaguaccagacaauaacgaacuaggcgaaagacuacucuuuuggcuaaguccgaacgacuuaguauaccuaccaacaucagacgaaguagaaucagguauauguugcaacaaauuagguauagacagaaucuacaaaaugguaucaugcacaggauauguaggagacuuuauacccgcgcacauugcaaacccaaucauacaaacuuuagaauuaggaucgaauaauaaagcacaaagagcauggacaggagaaaugauaaaagaaauauguauacccgucaaaguagaccgcaugggaaacauaguagaaauauuuaauagaaacaaaaauuga

SEQ ID NO: 9255 - RNA, 4695 nt, Artificial Sequence
  Cas9 variant
auggccaaaauauugggacucgauuuggguacaaauucuauagggugggcaauaguagaugacaaaaacagcaaaauauuagauacaggcguaagaauauucccagaaggaguuguagcaaaaacaaucggaagcggagauaaagaagaaagcaaaaaugcuaaacgccgagaaucaagacaaacucgacguggcuuuuauaggaaacgccuucggaaaauuaaauuacuaagaacacugaucaacuucaaaaugugcccauuagaacauuucgaauuagaugucuggaguaaaugggauaaaaucaagaagaaagaagguagaauggcaccagaacuauuccugccagaaaauucggcauauaaccuuuggcuaaaacaaaauccauacauucuacgagacaaagcucuaagcaaagaccuuacauuaacugaauuuggaagaguacuauaucaccucauacaaaggcgaggauuuuuaucaaaccgcaaaggaaaagaugaugggaaaaucuaugggggaaaagaaggaaucguggguauagacaaaacuaacgaacaaaucaaaaacaguacguuagguaaauucuuauuuaaaauauuaccgaaagaaggagaaccauuuaaaaucauagaagacgaacuagguaacgaacuaagagugcgaucccgcuacacgcuaagagacauguacauagcagaguucgaagccauauggaaccgccaggcaaaacauuuaggccuagacaacaucuacuacagcaaugucaaaaauguuuuauuaaaaggaucgcucaaaaauaagaaaaaugaacggaaaauuaaccaccuuaagaaaauaaaaggcaacggcaacauagaaauuauaacgcuaaacaacaaccuauccaaaaaugaaaaaccaaaauaccugcugaaaauagcuaccaaauuaccauuaaaagaguucuuggcaggaagaauagaaaaagaugaagaugggaaaauuaaauucaaaucaaacgaaucaguacuguucuggcaacgaccacuaaggucacagaagaaauuacucgccaaaugcagauucgaaccugaccuuaaagaugauaacggcaaauucauacaaaaaggaaaaacaccaugucauuugucacacccucuauaugaagaauacagagcguaucaauaugucaacaauauagaauacgggaagaaacaaagauuagaagaaucccaaagaaaacaaguaauagaccuuauuaacuccaaagauggaaauuucaaauuuagugaaaucaaaaagaaacuuaaacugucguaugaaacauuuaacuauucagaugauucuucuguaaacggaaauuauaugaucaaaaacuuaaauucaauauuuccaaaagaaauauuagaaaaagaguuuguagucaacguuaacaaagaagacauaauagaauacggcuacgagcgaauauggcauuuauuucauuucugcgaagauaacgacguguuaauuaagaaacuacaagauaacuuugauuugucagaaaaugacauagagaaaauaucaaaaauaaaccuaaaagaaggcuacaguaauguaucauuaaaagcaaucaaaaacauacuaccauaucuaaaagaagguaaacuuuuaagcgaugccgucaucuuagguggaguccgaaauguauuugguaagaaauggcaugaguucaucgauuuccacgagaaaauagaaaaagauauuuuauacauaaaccaucaaaagagcaacaaagaaggagaagcaaucgagaaaauaaagaaauacuugauagauuacaaauucggguucacagaaaaugacaauagguucaagaaacuauaucaccacagccaagacguaguggaagucaaacuccagaagaaaauagggccggucgaagauuuaagaaacccaauagugcaacaagguguuaacgaagugcgucgccuuguaaacgaacuccuugacguccauggaaaauuugaccaaguaagagucgaacuaggaagagaccucaaaaacaauaaaucuaaaagagaagaaauaggauauaaaauucgugaaaacacagccaaaaaugaaaaagcuaaagaauuacuaauugaauacggucugagacaaucccgugauaacguccaaaaaguauugcuauuccaagaaauguuagauagaggaaccguagcaguuugccccuacacuaacaaaacaauaaacauuuccgacguccugggaaacgaaaauaaaaugcaaauagaacacauaauaccgaaaucgauaagccucgacgacucauucgcaaauaaaacccugugugauucaaaauucaauggacucaaaggagaaagaacaccguacgaguucuaccaaauaaacaaugaugcuaauuuauggggagggagcaaauccugggaagagauagaaagaagaaccuuucgaauacuaccauacagcaaagccaaaagauucacaaguaaaaccaaauucgaaaccaacgacuuuauccaaagacaacuaaaugacacaagauacauaagcaagaaaacuaaagaaauacuaucacagauaugcgaagauguaagagucaugcccggauccuuaacagcagaacuaagaaaauuauggggguugaauaauauucuccacccagcauuuguacuugaccugcccgcauuacacauagacgcgaauaaacacauaccccauuauguaguauuggaugaagacaauguaccuauauuaagucaaagaauauacaacgacaaaccaaucuuaaaagcaaaccaaacaaguauaacaggauucguagacaacgaaauuuuuaaaagcaaagagaaauacguuaaauuugaggugaaagccccaaaucuaagcaacggugaauacugggccaaauuguuacucagcaaucccaaaucaauaguacguguuuuuaaagaaaaaccuaaaaguaccgaaaaugaaaucguagucagaggcaagaucgaaaaagaaaaguucaaacacgaaggacuaucagggauuaacgcugaaggaaaagaaaaugguacauacugggcaaaacuuagcauaguagauaagaaauuuaagaaaccaaagaaagaugaucaaccaaagaaaaacggcaaacaaauucuguuauuuggagcaguuaaagagggcguauucagcaguuauauguaugagugugacgccgacuuagaagacggaaaauacuggcugauacucgauauugauuuugaaaacguagaguucgaaaaagcacuaaacgaacgacccgaaguccuagaaaaucaaauccucauacaaggcauaacaaaugaugaaaauguauucguuagugacauggauugccaacaccaauuucuaaugaaugaaggaaaaggaaaauauuauguucuauucgacauaauaagugaaguaaacgaguuuuaucccauaaaaacaaaaucuccagaauuagaaaacggacaaucauuaacagaagguaccauauggguagauaaauacacaggggaaauaaaauucgaucccaagaaaaauagagaggaucacagacaccaugcaaucgacgcucuaguuauugcacuaacaaaagagacauacuuucaacaauuaagucgacguaaugcaucaucagaaaauaagaaacguggaaaugaauaugaaaaagaacaacucgacuucgccgaaccauggaaagaguuucacguagaugcucagaaauccaucaacucuauacucauaagccauaaacagaauaaaaauauacuaacuaaaaucacaaagaaaauuaccaaaaacggaaaaacauauaaaagcgaaggaaugaguguacguggccaauugcacgacaaaacauacuauggccacaauaaaaacugcaaagcagacgaauacgucuaccggguagacauaaacaaucuuagcuucagucagcucacuaauauaaucgacuuaaauuuaaaagcagucauuguugaaggcgucauaaagaaauucgaggaaagcgaaaaauuacucuucaagaaaaugaacucaaagguucaaaaucuugacaaaucaaaaguaaagaagaucaaggcaaaaguggauaagauacuaaaagaaaccagcuuuuucaugccaaacgaaggaaaacgcuacauacgacuuaacaucaucgaaccagcaaauuuugagagaaugcccguacccaucaagaaaguaagaauaagaaaaguacuacgaaaugccgagaaacuuaauaacgaaauaaaacaauuuguagacccucaaaauaaucaucacguacuaauauacaaagacgaaaacggaaaucucaaagaagaggucguaaccuucuggacaguaguagaaagaaaacgaaccggagaaccaguauauaaauuaccuagugauggcaaaaagauaguaacaacccuacaaauuaacgauauguuucuccuaggauugaacgaagaugaaauaaauugggaaaauccaaauuauaaccacuuaaaagaacaccucuaccgaguucaaaaauuuacaaguggcgauuuuuacuucagaauagcaaaaacaucaucuauacagaauggggaagaaaaacaacaaauaaauuccuucggacuagggaaaaacggauggcuuacucacaacccuauaaaagucaaaaucucggucuccggaaaaaucuuaaagguauga

SEQ ID NO: 9256 - RNA, 4713 nt, Artificial Sequence
  Cas9 variant
auggaaaauucaaacaauucuucuaagaaauauuauuuaggacucgauauggguacugauuccugcggcugguguguuacagacgacaaauauaauauaauccguucgcacaagaaaauauacggaccagauggcaaacuuguaaaaagagaaggaugucacuuauggggaaguagacuauucagaccggcaaacacugccaaaaguagaagauuaaaucgaacagcgagaagaagacuugcaaggcgacgaagacgaauaauacuauuaagagaacuauuccaacccgaaauagauaaagucgacccaaauuucuuuagaagacuagaccaaucaaaccuauggaacgaagacaaagauaaagagcuacaaauggaacacaacuuccuauuuaaugauaaagaccuaaccgauaaagaauauuauaaagauuuuccaacaauauaucacuuaagaaaagcaauggucaacggccugacaauuaacggauauuauuacgaucccaagaaacaauuugauauaagagaaguguauuugguacuagcccacaugaucaaauacagaggaaacuuccucauggaaggagacguaaaagauucuguggucgacccaacauauuuaaaacaauguuuugauaauauugacguaauccuaauaucacugaauaacggagaagaugacgaaaaugaagaugauaaaaucgauccaucagaaugcugcuucaauguugaugaaaagaaagcuagaaaacucgcgaauaauuuccaagaaaccaacaaaguaucggauuuagaagaugaugaaagagacuuauuuggaaaauucaacucaaaagauauuaggaagaaaauauuaaaauuaauaaacggaggaucuggugugaaauuaaaagauuuucuaccuaaagaaauacugguugcccaugacggugacgaugaauauggagacaagaaaaucgaucuaucaucagaaacauuagaagacgacauuaaugguuacagucuaccagaaucauacguugaaauaauauuagaagcaaagaaaauauaugacuucaaaacuuuagccuauuuacuacauggaaaaucacuacuaugugacgcuauggucaauguuuaugaagaacacaaagaacaacuagcagcacuaaaacgauuauauaagaaauaugccacaaaagaacaguacuauuuuauguucagagacagcagaaucuuagauggagaugacucagaugacgaggaagacaaagaggaaucaaacaaagaagagagcaaagacaaaaagaagaaagcaagcuaugucuccuacaucggauacacgaaaacaaacucuaaagcaaaauacacaggugcccacauuacaagugagaaaaauauaucugcccuaauaaaacaaauuaaagacgaucugaaauucgacgacuugaaaucaaaaguagaugacccuucucaacaaaacgaacuaucggaugaagauaaauuagauauacaguguauagaagaagcaauagaaucuaacacuuuucugccuagacaaaacuccagaaauaacggagcguucccauaccaacuaaauuuaaaugaaaugagaacuauaauugaaaaucaaaguaaauacuacccauucuuaaaagacaaagccccgaguuuccccgauggaaaaacagaagaauacaaaaucgucagcuuacugaaauucaaaauucccuacuacaucggaccauuaagccaaccaaacgacuaugucagagacgacaaaagagacaaucacuggguccaauuccgaggggaaaauaaucaaggaauaauaaaccccuggaauuucucacagauuguugauuuagaagguaccgccgacaaauuuauaaguaaccuaaccaauuauugcacuuacauauuuggugaaaauacacuaccaaaagagagucuaaucuuccaagcauacaaaguucuaaaugauuuaaacaaccugaaaguaaacggcucacuaauaucaaaagaagauaaagacuacauaauacaaaacguauaucuuaaaaagaagaaaauaaaaggcaaagacauaguaaacgcacugaaaaacaaauacaaacuaucagacgaagacccaacuguaacaacaaaaggaaguggaaaaaguauaggcgaagaugaagucgaucuaacuauguuuaacaguagcuuaucaucuuuuauagacaugagugacccaaacgcauuugggcccgaauuuuauaaagauagcaacaaauuugaauuagcagaaaaagucauagaacuuauaacaauaguagaggacaaagauuuauuaaaagagagacucaagaaauuaggccucagcgauaaucaaguaaacuaccuuuuuaaacagaaauauaguggcugggcaccacuaucacggaaacuucuagauggaauaacuauugacugcguuaacgagaacacuggagaggccuacccugugacaauuauugauguaaugagagauacaccgcuaaacuucauggaaauuuaugagacaaaagaaucccaauuuucagguuuuaaagaaaaagucgcagaacucaacgacgagaagaaacuaagcagggaugauuuaauagaagaaucauacgccuccccagcaaugaaaagaagcgucagacaaacauucaaagucaucgacgaacuaaagaauacauuaaacauugaccauuucgaucgcauauuuguagaagccacgagagcgccaggugaagccggaaaaaugguaaagaguagaaagaaacaacuacaagaggcauacgaugcagcaaaagaucucgucgaccaagaaagcagggacgaccuccaaaaauuacgagaugaucuugaaaaacaaacagaugaccagcuacgacgaaagaaaguauaccuuuauuuuaugcaacuagguagaucuguauacucaggugagaaaauugauuuaaacgaacuggauaaaaauuacgacaucgaucacauuauaccacaagcaaaacucaaagacgauuccuuuaauaacauggucuuaguugaacgugaauuaaauaauaagaaacaagacgaauauccaaucccaucaacaauaauauccgagcauggaagaaacuggauacaaaaacuugcgaaaauccaagacaagaacaaacgaaguuacuuuaugccuaaagacaaagccaaccgauuacuaaggcccgaaucaaaacaauugacuagcgacgaacuaaacggauucaucaauagacaauuaacccuaacuaaucaaaguguuaaagcaguuugcgauauacucaaaaugacugaaaaagguucagaaauuguauauucaaaagccaauuuuguaucagacuuuagaaaauuauguggugaacuaagaccaagcuaugaugcauucguaaagguccgcgauauaaaugauuuucaccacgccaaugaugcuuacuuaaacaucguuguuggcaacguauacuaugaaaaguuuaaaaacuuuuauauuaacaauagaaucgauuacgacaauaaugggaaaaaggacuugagcguacuagcaucaaaauuauucacgaaaacacaagcagaugacaaaacagguaauauauacugggaagcaagguuccacaacgaaaaagaaaccgacucgaaugguaaagagaggacgaucaaagucagagaugaggguacugaaagcaccuuugauaagauagaguacuacauggaacugaacgauccucucgugacacaaaugcaauauacacuuaguggaaaacagggguucuuuaagaaaauaacucuuaaaacaaaagcaaaagauaaugaagauaauucagauaaacuauucccuuuaaaacaauauuuaaggucagacucaaacaagguaauggauguaaauaaauacggaggauauucugauaugauuaccccuuacuuuaugcuaguucaaagcgaaggcaagaaagguaaacauauauauagccuagaaucaauaccaacaaucuaccuuaagagcuuuaagaaaaaggaagaagacauaaucaauuauuuaagcuguaaaaacaaauuaaagaaucccguaguuauaagugacaaacuacugaugagaaccauaguuaaaauuccauacuuuaaaaaugauucaaaccuaucauuaguaaaacucggaacgucaggaagaacaggaaauaacaucauauacauaaauuuaucagaacuaauauugccaauagaauggaaaaacuacuaucgcaaaaucucaaaccuauuaggcacuaacgugagcucaacaaaaccaaaagaucuaaguaaauuuacagaacaaaugaaaaacgauccaacuagcacucugguagacgggaguaauaaaguagaacaugacaaaaacaacagauucuuuaguuaccuaauaaacaacguaauuaauaaacccauauuugaaggauuaccuaagacauccuguucauucaucaaacuggaaucaaaguacgacgaauuuugcucguuaaauacuuuagaacaagccaagaucauugcaacgauaauaaaacuuuuaucauguaaaucagugcaaggaugcaaguuaaguaauuuaucaggauuaccuucaucguuaggagcacuuaucaguaacaaagcgcuaacggaaggaacaaucauauccaaagagucgagcuguggucuaaaagaaaacauuauauucguagugccaaacgacuga

SEQ ID NO: 9257 - RNA, 5067 nt, Artificial Sequence
  Cas9 variant
auggaauuuaaaaaaguauuaggauuagacauagggacaaacaguauagggugcgcccuacucucauuaccuaaaucaauccaagauuacggaaaagguggacgauuggaauggcuaacuagcaggguuauaccacuagaugcggauuacaugaaagcuuucauagauggaaaaaacggcuugccgcaagugauaaccccggcaggcaagcgaagacaaaaacgcggaaguagaagacuaaagcaucgauacaaauuaagaagaucuagauuaauaagggucuuuaaaacacuaaauugguuaccagaagacuuuccucuggauaauccaaaacgaauaaaagaaacaauaagcacagaagggaaauuuagcuuccgaauaucagacuacgucccaauuagcgaugaaucauacagagaauucuacagagaguucggauacccagaaaacgaaauagagcaagucauagaagagauaaacuuccgaagaaaaaccaaaggaaaaaacaagaacccaaugauaaaauuauugccagaagacuggguaguuuauuaccucagaaaaaaagcauuaauaaaaccaacaacaaaagaagaacucauaaggauuauauaccuauuuaaccagaggaggggguuuaaaucuucccgcaaagaccuuacggaaacagcaauccuugauuacgaugaauucgcgaaacgcuuagcagaaaaagaaaaguacucugcggaaaauuacgagacaaaauucgugucuaucacaaaaguaaaagaaguaguagaacuaaaaacagaugggagaaaagguaaaaaacgguucaaaguaaucuuggaagacucuaggaucgaaccuuacgaaauagaacgaaaagaaaagccugauugggaaggaaaagaauacacuuuucuaguuacccaaaaacuagagaaaggcaaauuuaaacagaauaagccugaccuacccaaagaagaggacugggcacugugcacaacagcacucgacaacagaaugggaagcaaacacccgggugaauuuuucuucgaugaauuauuaaaagcauuuaaggaaaaaagaggauauaaaauaagacaguauccaguaaaccgauggcgauacaagaaagaacuagaauucauauggaccaaacaaugccaacugaacccagaacucaauaaccuaaacauaaacaaagaaauauuaagaaaacuagcaacaguccuguacccuucucaaucgaaauucuuuggcccuaaaauaaaagaauucgaaaacucugauguacuacauauaauaucggaggacauuauauauuaccaaagagacuuaaaaucacaaaagucgcucauuucagaauguagauacgaaaaaagaaagggcauagacggagagauauauggacuaaaaugcauaccaaaaaguaguccguuauaucaagaauuuagaauauggcaagacauccauaacauaaaagugauaagaaaagaaagcgaggucaacggaaaaaagaagauuaacauagacgaaacacaauuauauaucaaugaaaacauuaaagaaaaacuauucgaacuauuuaacaguaaagacucauuaagcgaaaaagauauauuagaauuaaucucauuaaacauuauaaacaguggaauuaaaauaucaaaaaaggaagaggaaacgacucaucgaaucaaccucuucgcaaaucguaaagaacuuaaagguaaugagacgaagagcagauauagaaaagucuucaaaaaauuaggguucgacggagaguauauuuuaaaucauccuagcaaauuaaauaggcuauggcauucagacuauucaaaugacuacgcagacaaagaaaaaacugaaaaaucaauauuaagcucgcuggguuggaaaaacagaaacgggaaaugggaaaaaagcaagaacuacgacguauuuaauuuaccauuggaaguagcuaaggcgauagcuaaccucccaccacuaaaaaaagaguauggaucauacagcgccuuggcaauacgaaaaauguugguuguaaugagggauggaaaauacuggcaacaucccgaccaaaucgcaaaagaccaagagaacacgagcuuaauguuauucgacaaaaaccucauacaauuaaccaacaaucaacgaaaagucuuaaacaaauacuuacuaacccuagcggaaguucaaaaaaggagcacacucauaaaacagaaauuaaaugaaaucgaacauaauccguauaaacuggaacucgugagugaccaggacuuggaaaaacagguucuaaaaucauuccuugaaaaaaagaaugaaucagauuacuugaaaggauuaaagacauaccaagcaggguaucuaaucuacgggaaacacagugaaaaagacguaccgauuguaaauucccccgaugaacucggagaauauauaagaaaaaaauuacccaacaauucucucagaaacccaauuguagaacaaguaauacgcgaaaccauauucaucgugagagacguauggaaaucuuucgguaucauagacgaaauacacauagaacucggacgagaguuaaaaaacaauucugaagaaagaaaaaaaacgagugaaagccaagaaaaaaauuuccaagaaaaggaacgcgccaggaaacugcucaaagaacuucuaaauaguagcaacuuugaacacuacgacgaaaacggaaacaaaaucuuuucaaguuuuacagugaacccaaauccugacagcccacuggauauagagaaauuucguauauggaaaaaucaaucaggucucacagacgaagaauuaaauaaaaaacuaaaagacgaaaaaauacccacagaaaucgaaguaaaaaaauauaucuuaugguugacgcaaaaaugccgaagcccauauacuggaaaaauuaucccucuaucgaaacucuucgacucaaaugucuaugaaauagaacacaucauaccuagaucaaaaaugaagaacgacagcaccaacaaucuugugauaugugaacuagguguuaacaaagcaaaaggagauagacuagcagcaaauuuuauaucagaaaguaauggcaaaugcaaguucggagaggucgaauacacgcuacuaaaauacggagacuaucuucaguacuguaaggauacguucaaauaucaaaaagcaaaauauaaaaacuuacuggcaaccgaaccaccagaagacuucaucgagcgacaaauaaaugauacacguuacauaggaagaaaacuagcagaacuccuaacucccgucgucaaagauuccaagaauauaaucuucacuauuggaucaaucacaucagaacucaaaauaacauggggacuaaacgguguuuggaaagacauacuacgaccaagauuuaaaaggcucgaaucaauaauaaauaaaaaauuaauauuccaagacgaagacgauccaaacaaauaccacuucgaccuaucuaucaacccacaauuagacaaagaagggcuaaaacgauuagaucacagacaucacgcacuugaugcaacaauuauugccgccacaacgcgagaacacguacgauaccucaauagcuuaaaugcagcggauaaugacgaagaaaaaagagaauacuuuuugaguuuguguaaccacaaaaucagagauuuuaaauuaccgugggagaauuucaccucagaaguuaaaaguaaacuauuaaguugcguuguaagcuauaaggaaucaaaaccaauucugucagauccauuuaacaaguaucugaaaugggaauauaagaacggaaaauggcaaaaaguuuuugcaauacaaauaaaaaaugacagauggaaagcagugcguaggagcauguuuaaagaaccaauuggaacaguauggauaaaaaaaauaaaggagguuuccuugaaagaagccauaaaaauacaagccauaugggaagaaguaaaaaacgauccaguacguaaaaaaaaagaaaaauacauauaugaugauuacgcacaaaagguuauagcuaaaauugugcaagaguugggucuuucaagcagcaugagaaaacaagaugacgaaaaacuaaauaaauuuauuaacgaggccaaggucucugcgggcguuaacaagaaucuuaauacgacaaauaagacgauauauaaccuggaaggucgauuuuaugaaaaaaucaaagucgccgaauacguuuuauauaaagcgaagagaaugccacucaacaaaaaagaauacauagaaaagcuaucacugcaaaagauguucaacgaccuucccaauuucauacuggaaaaaagcauacuggacaacuacccagaaauacuuaaggagcucgaaucggauaauaaauacaucauagaaccacacaagaaaaauaauccuguaaacagacuuuuacuagaacacauuuuggaauaucauaauaaccccaaagaggcauuuaguacugaaggccuagaaaaacucaacaaaaaagcaaucaauaaaauuggaaaacccauuaaauacauaacacgacucgauggugacauaaaugaagaagaaauauuucgaggggcgguuuucgagacagacaaaggaagcaacguuuauuuuguuauguaugaaaauaaccaaaccaaggaccgcgaauuucuuaagccaaauccaagcauaagcguacuuaaagcaauagaacauaaaaacaagauagauuuuuucgcaccaaaccgauuaggauuuuccagaauaauucuuuccccaggagacuuaguuuacguaccaacuaaugaucaauacguacucauaaaagacaauucauccaaugaaacgauuaucaauugggacgacaaugaauucauuucaaaucgcauuuaccaaguaaaaaaauucacgggaaauucuuguuacuucuuaaaaaaugauaucgccagccugauucuauccuacagcgcaucaaacggagucggagaauuuggaagucaaaacauuagugaauacucaguagacgacccccccauucgaauaaaagauguuugcauaaaaauucgcguagacagacucggcaaugucaggccucuauga

SEQ ID NO: 9258 - RNA, 3924 nt, Artificial Sequence
  Cpf1 variant
augacucaauucgaaggauucacuaauuuauaucagguuagcaaaacguuaagauucgaauuaauuccccaaggaaaaacacuaaaacauauccaagaacaaggauucaucgaagaagauaaagcaaggaacgaucacuacaaagaacucaaacccauaauagaucgaauauacaaaaccuaugccgaucagugccuccaacuuguccaacuagacugggaaaaucuaucugccgcaauagacagcuacagaaaggagaaaaccgaagagacacgaaaugcccuuauagaagaacaagccacuuaucgaaacgcgauacacgacuacuuuauaggaaggacagacaacuuaacggaugccaucaauaaacggcacgcagaaauuuauaaaggauuauucaaagcugaauuauucaauggaaaaguacuaaaacaauuaggcacagucacaacuaccgaacacgaaaaugcccugcuuagaucguucgauaaauucacuacauauuucagcggcuuuuaugaaaauagaaagaauguauuuucagcagaggacauaucaacagcaaucccccauagaaucguccaagacaauuuccccaaauucaaagaaaacugucacauauuuacccgauuaauuacugccgucccuagucuaagagaacacuucgaaaaugugaagaaagcuauagguauauucguuucaacuucgauagaagaaguuuuuaguuuuccauucuacaaucaauuacucacccaaacacagauagaccuauacaaucaacuacuagguggaauaucacgcgaagcuggaacugaaaagauaaaagggcuuaaugaaguacuaaacuuggccauacagaaaaacgaugaaacugcccacauaauagcgagcuuaccccacagauuuauaccauuauucaaacaaaucuuaucagaccgcaauaccuuaaguuuuauacuagaagaguucaaaucagacgaagaaguaauacaaucauucugcaaauacaaaacacuccuccgaaaugaaaaugugcuagaaacagcagaagcacuauucaaugaacuaaauucaauugaucugacccacauuuucaucucacacaagaaauuagaaacaauuuccagcgcccuaugugaucacugggauacgcuaaggaaugcccuauacgaaagaagaauaagugaacuuacaggcaaaaucacuaaaucagcaaaagaaaaaguacaaagaucucuuaaacacgaagacauaaaccuucaagaaauuaucuccgcagcgggaaaagaacugucagaggcuuuuaaacagaaaaccuccgaaauauuaagccaugcacacgcugcacuagaccaacccuuaccaacaacucuuaagaaacaagaagaaaaagaaaucuuaaaaucgcaacuagauagccucuuaggcuuauaccaucuacuagauugguucgcagucgaugaaagcaacgaaguagauccugaauuuucagcaagacugacaggaauuaaauuagaaauggaaccaucccuaucauuuuauaacaaagccaggaauuaugcgacaaagaaaccauacuccguugaaaaauuuaaacuaaauuuccaaaugccaacuuuagcaaguggaugggauguaaacaaagagaaaaauaacggugcuauccuauuuguuaaaaacggucuauauuauuuaggaauaaugccaaaacaaaaagguagauauaaagcucuaucauucgaacccaccgagaaaaccucugaagguuucgauaaaauguacuaugacuacuucccagaugcagcaaaaaugauuccaaaauguucgacacaacuuaaagcuguaaccgcacacuuccaaacucauacuacucccauauuauuaagcaauaauuuuaucgaaccccuagaaauuacgaaagaaauauacgaucucaauaacccagaaaaagaaccuaagaaauuccaaacagcguaugcaaagaaaacaggugaucaaaaaggauaccgagaagcucuuuguaaauggauugauuucacaagagauuuucuaaguaaauacaccaaaacuacaucuauagauuuauccagucuacgucccucuucacaguauaaagacuuaggagaauauuacgccgaacuaaacccacuacuauaccacauaucauuccaaagaauagcagaaaaagaaauaauggaugcaguagaaacuggaaaacucuaucuauuucaaauauauaauaaagacuuugcgaaaggccaucauggaaaaccaaaucuacacacauuauacuggacuggccuauucucaccagaaaaccuagcuaaaaccagcauaaaacucaauggacaagcagaacucuucuacagacccaaaucucgaaugaaaagaauggcucacagacuaggagagaaaaugcuaaacaagaaacuaaaagaccagaaaaccccaaucccagacacauuauaucaagaauuauacgacuauguuaaccacagauugucgcaugauuuaagugaugaagcucgcgcacuauuacccaacgugauaacuaaagaagucucacacgaaauaauaaaagaucgacguuucacuagcgauaaauucuucuuucauguuccaauaacauuaaauuaucaagcagccaauucccccucaaaauuuaaccaaagaguaaaugcauaccucaaagaacacccagaaacacccauaaucggaauugauagaggagaaagaaaucuaaucuacauaaccgugauagacaguaccgggaaaauucucgaacaaagaucccuuaacacaauccaacaauuugacuaucagaagaaacuagauaaucgcgaaaaagaacgaguugcagcuagacaagcauggucaguuguaggaacuauaaaagaccuaaaacaaggauaucuaucucaaguaauccaugaaaucguagacuuaaugauucauuaccaagcagucguaguacucgaaaaccuuaacuuuggauuuaaaucaaaaaggacuggaaucgcugaaaaagcagucuaccaacaauuugagaaaaugcuuauugauaaacucaacugucucguauuaaaagacuacccagcagaaaaaguaggaggcgucuuaaaccccuaucaacuaacagaccaauuuaccucuuucgccaaaaugggaacacaaucaggcuuccuuuucuauguuccagccccguauacauccaaaauagacccuuuaacuggauucgucgacccauucguauggaaaacaaucaaaaaucaugaaucacgaaaacauuuccuagaaggcuucgacuuccuucauuaugaugugaagacgggugacuucauacuacacuuuaaaaugaauagaaaccucucauuucaacgugguuuaccagguuuuaugccagcaugggauauaguauucgagaaaaaugaaacacaauucgacgcuaaagguacaccguucauagcaggcaaacguauaguuccagucauagaaaaucaccguuucacagguagauaucgcgaucuauauccggcaaacgaauuaauagcccuguuagaagaaaaagggauaguauuuagagaugguaguaauauacuaccgaaacucuuagaaaaugacgacucacacgcgauagauacaaugguugcacuaauucguucaguccuucaaaugcgaaacucuaacgcagccacgggagaagacuacauaaauuccccaguucgagaucuuaacgguguauguuucgauucaagauuucaaaauccagaauggcccauggacgcugacgcgaacggggcauaucauauugcauuaaaaggacaacuccuucuaaaccaccuaaaagaaucuaaagaccuaaaauugcaaaacgggaucucaaaccaagacuggcuagccuauauacaggaacuaagaaacuga

SEQ ID NO: 9259 - RNA, 3903 nt, Artificial Sequence
  Cpf1 variant
augucaauauaccaagaguucguaaacaaauauagucuaagcaaaacacucagauuugaacuaauaccgcaaggaaaaaccuuagaaaauauaaaagcacgaggacuaauacuagacgacgaaaaacgcgcaaaagacuacaagaaagcaaaacaaaucaucgacaaauaccaucaauucuuuauagaagaaauacuaucaagcguaugcauaucagaagaucuacuccaaaauuacagugaugucuauuuuaaacuuaagaaaucugacgaugauaaucuacaaaaagacuuuaaauccgcuaaagacacaaucaagaaacaaauauccgaauacauaaaagacagcgaaaaauuuaaaaaucucuuuaaccaaaaccuaauagacgcuaagaaaggucaagaauccgaucuaauucuauggcuaaaacaaucuaaagacaacgguauagaacuuuuuaaagcaaauucagauauaacagauauugaugaagcgcuagaaauaauaaaaucauuuaaaggauggacaacauacuucaaaggcuuccaugaaaaucgcaaaaauguauacucaagcaaugacauaccaacaucuauaauuuaucgaauaguagacgauaaccucccuaaauuucucgaaaacaaagcuaaauacgaaagucuuaaagauaaagcccccgaagcaaucaacuacgaacaaauuaagaaagaccuagcagaagaacuuacauuugacauagauuacaaaacaucagaaguaaaccaaagagucuuuucauuggaugaaguuuucgaaauagcaaacuuuaacaauuaccugaaucaaagugguaucacaaaauuuaauacuaucauaggugguaaauuuguuaauggcgaaaacacaaaacgaaaagguauaaacgaauacauaaaccuauacucucaacaaauaaacgauaaaacacuaaagaaauauaaaaugagugugcuauuuaaacagauucuauccgacacagaaucaaaauccuucguaauugacaaacucgaggaugacagcgacguaguaacaacuaugcaaaguuuuuacgaacaaauagcagcuuucaagacaguagaagagaaauccauaaaagagacgcucagcuuauuauuugacgauuuaaaagcgcaaaaauuagaccuuagcaaaauuuauuuuaagaacgauaaaaguuuaaccgauuuaucucaacaaguauuugacgacuauucuguaauaggcaccgccguucuagaauacauuacacaacaaauugccccaaagaaucuagauaacccaucuaagaaagaacaagaacuaaucgcaaagaaaacagaaaaagcaaaauaucuaucccuagaaacaaucaaacucgcgcuagaagaauuuaauaaacaucgagacaucgauaaacaauguagauucgaagaaauccucgcgaacuucgcagcaaucccaaugaucuucgacgaaaucgcacagaacaaagacaacuuagcacaaauuucgaucaaauaccaaaaucaaggaaagaaagaccuccuucaggcuucugccgaagaugacguaaaagcaauaaaagaccuccuagaucaaacaaauaaccuauuacacaaacucaaaauauuucacauaagucaaucagaggauaaagcaaacauucuugauaaagacgaacacuucuacuuaguauuugaagaauguuacuucgaacuugcaaacauaguaccacucuacaacaagauacguaacuauaucacacaaaaaccauacagcgacgaaaaauucaaacuaaauuucgaaaauucaacgcuagcaaacggaugggacaagaauaaagaaccugauaacacagcaauacuauucauaaaagacgacaaauauuaccuuggaguaaugaacaagaaaaacaacaaaauauucgacgauaaagcaauaaaagaaaacaaaggagaaggguacaagaaaauaguauauaaacuacugccaggugcuaauaaaaugcuuccaaaggucuucuuuagugcgaaaucuauuaaauuuuauaacccauccgaagauauuuuaagaauacgaaaccauucaacacauaccaaaaaugggucaccacaaaagggauacgaaaaguuugaguucaacauagaagacugucgaaaauucauagacuucuauaagcaaucgaucuccaaacauccagaauggaaggauuuuggauuuagauucucugacacccaaagauauaacucaauagacgaguucuauagagaagucgaaaaccaaggauauaaauuaaccuucgagaacauaucagaauccuacaucgauucuguaguaaaucaagggaaacucuacuuauuccaaauauacaauaaagacuuuucagcauacuccaagggacgaccaaaccuucauacauuauacuggaaagcucuuuucgacgaaagaaaccuccaagacgucguauacaaguuaaacggagaagcggaacuauucuauagaaaacaaagcauaccaaagaaaauaacacauccagcuaaagaggcuaucgccaauaaaaauaaagauaaccccaagaaagaaucaguuuuugaauaugacuuaauuaaagacaaaagauucacugaagacaaauuuuucuuccauuguccaauaacaaucaauuucaaaagcucaggagccaauaaauuuaacgacgaaauuaaucuacuacucaaagaaaaagcuaacgauguucauauucuauccauagaucgaggagaacgucacuuagccuacuauacccuaguagauggaaaaggaaacauaauaaaacaagauacauuuaacauaauuggaaacgaucgaaugaaaacaaauuaccacgacaaauuagcagcaaucgaaaaagaccgcgacuccgcaagaaaagacuggaagaaaaucaacaacaucaaagaaaugaaagaaggcuaccuuucacaagucguucacgaaauagcuaaauuaguaauagaauauaaugcaauaguaguauuugaagaucuaaacuucggauucaaacguggacgcuucaaagucgaaaaacaaguauaccaaaaauuagagaaaauguugaucgaaaaacuaaacuaccuaguuuucaaagauaaugaauuugacaaaacagguggagugcucagagccuaccaacuaacagcaccauucgaaacguucaagaaaaugggaaaacaaacuggcauaauauauuacguaccagcaggauucacaucaaaaauuugcccuguaaccggcuuuguuaaccaacuauaucccaaauaugaaucggucagcaaaagucaagaauuuuucucaaaauuugacaaaauuuguuauaaucucgacaaaggauauuuugaauuuagcuucgacuauaaaaacuucggcgauaaagcagccaaaggaaaauggacgauugccaguuuuggaucacggcuaaucaauuucagaaauucugacaaaaaccacaacugggauaccagagaaguauaucccaccaaagaauuagaaaaacuacuaaaagacuauucgaucgaauauggacacggagaaugcauaaaagccgcuauaugcggugaaagcgacaagaaauucuucgcaaaacuaacaucaguauuaaacacuauauugcaaaugcgaaacucaaaaacagguaccgaacuagacuaccuaaucuccccuguagcagacguaaacgguaauuucuuugacucaaggcaggcacccaaaaacaugccacaagaugccgaugcaaauggagcuuaucacauaggccuaaaaggacuaauguugcuaggaagaauuaaaaacaaccaggaagggaagaaauuaaaucucguuauuaaaaacgaagaauacuuugaauuuguacaaaacagaaacaacuga

SEQ ID NO: 9260 - RNA, 1341 nt, Artificial Sequence
  Cpf1 variant
augaaaccugacauaaaagacagagaauauauguaucgauuaauaauaggacaauuauucuaugauggacaccaacaaauagccgucaauuuagcuaacacauuaggcugcagcgcgccaccacccccaccaagcgauaaacuauucaggcuaguaacuauugcaaaacaauuuguagaagaccccgacuauaaagcugaagaaaacacaaugccaaugcaauucgaaacaucuucugcaggacuagaccuccaauaugacgcugacguggcagcaacaucaccagaaccaucacaauacgaaacaauauauuuaacaguacauaaagcaccaugccgagcugcagcauucaacucagacggaucucuaauagcaacaggaucagcagauuguucaauaaaaaucauggacguagaaagaauacuagcacgugaaaaagaacauagagaaaugaacgaaaacggaccagacgcacaccauccaguaauaagaacauuauacgaccacguagacguacgacgcgacuucggaagauuuucagacaaaauacucgauuuccaagacguaaauacaguaauauuccauccaagagaugcaauccuaaucagcggaucaaaugacaaaacaguaaaacuauucgauuucuccaaaaccgccgucaaaagagccaugaaaacauuauccgaaguauacccaguaagagcacuaagcugucaucccggaggagaauuuuuauuaguagcaacagaucauccaacaguaagauuauacaauaucgaaaccgcacaagcauacgcaucagcaaacccugacgaucaacacagagaaucaguuacagacguacacuacucagaaaacgcuagacuauauguaacagcgucaaaagacggagacguaaaaguaugggacggaguaucaagcagaugcguagaaacauucaaaagagcacacgacggauccucaaucugcagugccaaauucacuaaaaauggaaaauauauauuaacaucaggaauggacucaauaguaaaauuaugggaacuauccacaaacagauguuuaauaguauauacaggagcaggagcuaccggagcacaagacuauccaacaucagcaucauucaaucaaaacgaagauuucgucuuauucccagacgaaaaaucaggaaguauguguucaugggaagcuagaaaugcagacagaaaacgcuuauuagcacucggacacacaucagcauguagaaccuucguucacucaccaucaaugccagcauuuaugacaggaagcgaugaucauagagcaagauuuugguacagaaaaccuacaacuaacgacaacuga

SEQ ID NO: 9261 - RNA, 1293 nt, Artificial Sequence
  Cpf1 variant
augaaacccgacauaaaagacagagaauauauguauagacuaauaauaggacaacuauuuuacgacggacaucaacaaaucgccgucacacuagcaaauacacuaggcuguucagcaccagcaccaccaccaucagauaaauuauaucgauuaguaacaauagccaaacaauucgucgaagacccagauuauaaagcagaagaaaaaucucuaccaaugcaauuugaaacagucucaacaggcuuagauuuagaauaugacgcugacguacaaccaguaucaccagaaccaucacaauacgaaacaauauaccuaacaguacauaaagcaccaugcagagcugccgcauucaacucagacggaucuuuaguagccacaggauccgcagauugcucaauuaaaauaauggacguugaaagaauauuagcaagagaaaaagaacauagagaaaugaacgaaaacggaccagacgcacaccauccaguuauaaggacauuauacgaucacguagacgauguaaauacaguacuauuucacccaagagaugccauacuaauaucaggaaguaaugauaaaacaguuaaacuauucgauuucucaaaaacagcaguaaaaagagcaaugaaaaccuuaucagaaguauacccaguaagagcauuaagcugucacccaggaggagaauuuuuacucguagcaaccgaucacccaacuguaagauuauacaauauagaaacagcccaagcauacgcuagcgcaaauccugacgaucaacauagagaaucagucacagauguacacuacucagaaaacgccagacuauauguaacagcaucaaaagauggagauguaaagauaugggacggaguaucaaaccgauguguagaaacauuuaaaagagcacacgacggaucagcaauaugcucagcaaaauuuaccaaaaacggcaaauauuuacuaacaucaggaauggacucaauaguaaaauuaugggaacuaucaacaaauagauguuuaauaguauacacaggagcaggcgcaacaggagcacaagacuacgccacaagcgcaucauuuaaucacaaugaagacuacguacuauucccagacgaaaaauccggaucuauguguaguugggaugcccgaaauucagauagaaaaagacuacuagcauuaggacacacaucagcauguagaacauucguacauagcccuagcaugccagcauuuaugacaggcucagaugaccauagagcccguuuuugguaccgaaaacccgcaacaacugacaauuga

SEQ ID NO: 9262 - RNA, 3690 nt, Artificial Sequence
  Cpf1 variant
auggccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaaguga

SEQ ID NO: 9263 - RNA, 3903 nt, Artificial Sequence
  Cpf1 variant
augucaauauaccaagaguucguaaacaaauacucccuuucaaaaacauuacgauuugaauugauaccucaaggaaaaacccucgaaaauauaaaagcacgaggacuaauucuagaugaugaaaaacgagcaaaagacuauaagaaagccaaacaaauuauagauaaauaccaucaauucuuuauagaagaaauucuuucaucaguaugcauaucagaagaccuacuacaaaacuacagcgaugucuacuucaaacuuaagaaauccgacgacgacaacuuacaaaaagauuuuaaaagcgcaaaagauacaaucaagaaacagauuucugaauacauaaaagacagcgaaaaauuuaaaaaucucuuuaaccaaaaccuuaucgacgccaagaaaggacaagaguccgauuuaauacuauggcugaaacaaucaaaagacaacggaauagaacucuuuaaagcaaauucugauauuaccgauauagacgaagcccuugaaauaauuaaauccuucaaagguuggacaacauacuuuaaaggauuucaugaaaaucgcaaaaauguauauaguagugaugacauaccaaccagcauuauauauagaauagucgacgauaaccucccaaaauuccuagaaaauaaagcuaaauaugagagcuuaaaagacaaagcaccagaagcgauaaacuacgaacaaaucaagaaagauuuagcagaagaacucacuuucgacauugacuauaaaacaucagaaguaaaucaaagaguauuuaguuuagacgaaguguucgaaauugcaaacuuuaacaauuauuuaaaucaaagcggaauuacaaaauuuaauacaauuauaggaggaaaauuuguaaauggugaaaacacaaaacguaaaggaauaaacgaauauauaaaccuuuauucacaacaaauuaacgauaaaacccuuaagaaauacaaaaugucaguccucuucaaacaaauacuuagcgacaccgaauccaaaucauucguuauugauaaacucgaagaugauucagacgucguuaccacaaugcagagcuuuuaugaacaaauagcagcauucaaaaccguagaagaaaaaucaauaaaagaaacccucucuuuacuauucgacgaccuuaaagcacagaaacuagaccuaucaaagauauauuucaaaaacgacaaaucacuaaccgaucuaucccaacaagucuucgacgacuacuccgugauaggaacagcagucuuggaauacauaacucaacaaguagcuccgaaaaauuuagacaauccaucuaagaaagaacaggaccuaauagccaagaaaacugaaaaagcaaaauaccuuuccuuagaaacaaucaaacuagcacuagaagaauuuaauaaacaucgagauaucgauaaacaaugccguuuugaagaaauauuagcaaauuuugcagcaauaccaaugauauucgaugaaaucgcccaaaacaaagauaaucuagcccaaauauccuuaaaauaucaaaaucaaggcaagaaagauuuauuacaagcaagcgcagaagaagauguaaaagcaaucaaagaucucuuagaccaaacuaacaaucuccuacaccgucuaaaaaucuuucacauaucccaaagugaagacaaagcaaauauacuagacaaagaugagcacuuuuaccuagucuuugaagaaugcuauuuugaacuagcuaauauagucccauuauauaauaaaauccggaacuacauaacacaaaaaccauauucugaugaaaaauuuaaacugaauuuugaaaauaguacguuggcaaacggaugggauaaaaacaaagaaccagacaauacagcgauauuauuuaucaaagaugacaaauacuaccucggagucaugaacaagaaaaauaauaaaaucuuugaugauaaagcgaucaaagaaaacaaaggggaaggauacaagaaaauagucuauaaauuacuccccggagcaaacaaaaugcuuccaaaaguauucuuuuccgcaaaauccaucaaauuuuacaaccccucagaggacauucuuagaauaagaaaucacucuacacauacgaaaaaugggaauccucaaaaaggauaugaaaaauuugaauuuaacauagaagacugccgcaaauucaucgauuucuauaaagaaucuauaucuaaacauccagaauggaaagauuucggauuucguuucucagauacacaacgauacaauucaauagacgaauuuuaucgcgaaguagaaaaucaaggauacaaauuaacauucgaaaacauaucugaaucauacauagacucaguaguaaaccaagggaaauuauauuuguuccaaauauacaauaaagacuuuagugcuuauucaaaaggacgaccaaaucuccauacuuuauacuggaaagcacuuuucgacgaaagaaaccuacaggacguuguuuauaaauuaaauggagaagcagaauuauuuuaccgaaaacaauccauacccaagaaaauaacccaucccgccaaagaagccauagcuaacaaaaacaaagauaaucccaagaaagaaucaguuuucgaauaugaucuaauuaaagacaaacgauuuacggaggacaaauucuucuuucacugcccaaucacaaucaacuuuaaaucaucaggggcaaauaaauuuaacgacgaaauaaaucuccucuuaaaagagaaagcuaacgacgugcacaucuuaucaaucgaucgaggugaaagacaccuagcuuauuacacacucguagauggaaaaggaaauauaauaaaacaagacacauuuaacauaauaggaaacgaucguaugaaaacaaacuaucaugauaaacucgcagccauagaaaaagaccgggauucugcacgcaaagacuggaagaaaauaaacaacauaaaagagaugaaagaaggauaucugagucaaguaguacaugaaauagcaaaacugguuauagaacacaaugcaaucguuguauucgaagaucuaaacuuuggauucaaaagaggcagauuuaaaguugaaaaacaaguuuaccaaaaacuagagaaaauguugauagagaaacugaauuaccucguauuuaaagacaacgaguucgacaaaacaggugguguacuacgugcauaccaauuaaccgcaccuuuugaaacguuuaaaaagaugggaaaacaaacaggaauuauauacuacguacccgcugguuuuacaucaaaaauaugcccaguaacaggcuucguuaaucaacuguauccaaaauaugaaucaguaucaaaaucgcaagaauuuuucucaaaauucgauaagaucugcuacaauuuagacaaaggauauuucgaguucucauucgauuacaaaaacuucggcgauaaagccgccaaaggaaaauggacaaucgcuaguuucggaucaagacuaauaaacuuccgcaacagcgauaaaaaucauaacugggauacaagagaagucuacccaaccaaagagcucgaaaaauuacucaaagauuacucaauagaauacggacauggcgaauguauaaaagcagccauaugcggagaaucagacaaaaaguucuucgcaaaacuaacgucugucuuaaauacgauacuucagaugagaaauucaaaaacagggacugaacuagacuaccucaucagucccgucgcugauguaaacgguaacuuuuucgacucccgacaagcacccaaaaacaugccucaggaugcugacgcaaacggugccuaucacauaggccuaaagggauuaaugcuacuagauagaaucaaaaauaaucaagaaggcaagaaacuaaauuuaguaaucaagaaugaagaauacuucgaguucguucaaaacaggaacaauuga

SEQ ID NO: 9264 - RNA, 1071 nt, Artificial Sequence
  Cpf1 variant
augaaaaccaauuaccacgacaaacuagcagcaauagaaaaagauagagaaagugcaagaaaagacuggaaaaaaauaaacaacauaaaagaaaugaaagaagguuaccuaagccaaguaguacacgaaauagcaaaacuaguaauaggauacaacgcuauaguaguuuucgaagaucucaacuucggauucaaaagaggaagauucaaaguagaaaaacaaguauaccaaaaacuagaaaaaaugcuaauagaaaaauuaaacuaccuaguauucaaagacaaugaauucgacaaagccggaggaguauuaagagccuaucaauuaacagcaccauuugaaacauucaaaaaaaugggcaaacaaaccggaauuauauacuacguaccagccgacuucaccucaaaaauaugcccaguaacaggauucguaaaccaauuauacccaaaauacgaaaguguaucaaaaucacaagaauucuuuucaaaauuugacaaaauaugcuacaaccuagacaaaggauacuucgaauucucauucgacuacaaaaacuucggagauaaagcagcaaaaggaaaauggacaauagcaucauucggaucaagauuaauaaacuucagaaacucagacaaaaaccauaacugggacacaagagaaguauauccaacaaaagaguuagaaaaauuauuaaaagacuacagcauagaauacggacacggagaaugcauaaaagccgcaauauacgcagaaaacgacaaaaaauucuucgcaaaacuaacaucaauauuaaacuccauauuacaaaugagaaacagcaaaacaggaacagaauuagacuacuuaauaucaccagucgccgauguaaacggaaacuuuuucgacagccgacacgcaccaaaaaacaugccccaagacgcagacgcaaauggcgccuaccacauaggccuaaaaggauuaauguuacucuaucgaauaaaaaacaaccaagacggaaaaaaacuaaaccuaguaauaaaaaacgaagaauacuucgaauucguacaaaacagaaacaaaucaagcaaaauauga

SEQ ID NO: 9265 - RNA, 3792 nt, Artificial Sequence
  Cpf1 variant
auggaagacuauagcggauuugucaacaucuacucaauacaaaaaacauugagauuugaacuaaaaccugucggaaaaacauuagagcauauugaaaaaaaaggauuucuaaaaaaagacaaaauccgugccgaagacuacaaggcaguaaaaaaaauuaucgacaaauaucaccgcgccuauauagaagagguauucgacaguguacuacaucaaaagaaaaaaaaagauaaaacacgauuuucaacccaguucaucaaagaaauaaaagaauucagcgaauuauacuacaaaaccgaaaaaaauauaccagauaaggaacgauuagaagcacuaucagaaaaacuuagaaaaaugcuaguaggagcguucaaaggugaauuuucagaagaaguagcagaaaaauacaaaaauuuauuuucaaaagaacuaauuagaaacgaaaucgaaaaauuuugcgaaacagacgaagaaagaaaacaaguaucuaacuucaaauccuuuacaacauauuucaccggauuccacaguaauagacaaaauauuuacagcgacgaaaaaaaaucaacugccauaggcuaccgcauuauucaccaaaaucuaccgaaauuccuagacaaucuaaaaauaaucgagagcauucaacgcagauucaaagauuuccccuggagugaucuuaaaaaaaaccugaaaaaaauagauaaaaacaucaaacucaccgaauauuucucaauagacggauucguaaacguacuaaaucaaaaagguauagacgccuauaacacaauacuaggagguaaaagcgaagaauccggagaaaaaauacaaggccuaaaugaauacauaaaucuauacagacaaaaaaauaauauagaucguaaaaaccuaccaaauguaaaaauucuuuuuaaacagauacugggugacagagaaacaaaaucauucauaccugaagcuuuuccugacgaccaaucuguacuuaacaguauaacugaauucgcgaaauaucuaaaauuagauaaaaaaaaaaaaucuaucauugcagaacuuaaaaaauuuuuaaguuccuucaauagauacgaguuagaugggauuuaucuagcaaaugacaauagcuuagccagcauaucaacauuucuauuugaugacuggucguuuaucaaaaaaagcguuucauuuaaguacgacgaauccgucggcgauccgaaaaaaaaaauaaaaaguccacuaaaauacgagaaagaaaaggaaaagugguuaaaacaaaaauauuauacaauaagcuuucuaaaugaugcaauugaguccuacucaaaaucucaagacgaaaaacgaguaaaaauacgacucgaagccuauuuugcggaguucaaaucuaaggaugacgcaaaaaaacaauucgauuuauuagaaaggaucgaagaagcauaugcaauaguagaaccauuacugggagcagaauauccaagagacagaaaucuuaaagcagacaaaaaagaaguuggcaaaaucaaagacuuccuugacaguauaaaaucccuacaguucuucuuaaaaccauuacuaagugcugagauuuuugaugaaaaggaccuuggauucuauaaccaacucgaaggauacuaugaagaaauagacagcaucggacaccuuuacaauaagguccgaaacuaucucacuggcaagauauauucuaaggaaaaauucaaacuaaacuucgaaaacagcacccuacuaaaggggugggaugaaaacagagaaguagcuaacuuaugcguaauauucagagaagaucaaaaauacuacuuagguguaauggauaaagaaaacaauacaauucucucagauaucccaaaaguaaaaccuaaugaacuguucuacgaaaaaaugguauacaaacuaauacccaccccccacaugcaacucccgagaaucaucuucagcucugauaauuuaagcauuuauaacccaaguaaaaguauauuaaaaaucagggaagccaaaagcuuuaaagaaggaaaaaauuucaagcuuaaagacugucauaaauuuauagacuucuacaaagaaagcauaaguaagaacgaagacuggagccgauuugauuuuaaauucuccaaaacauccaguuacgaaaauauaucagaauuuuauagggaaguagaacgacaagguuacaauuuagacuuuaaaaaaguuagcaaauuuuauauagauucauuggucgaagaugguaaauuauaucuuuuucaaaucuauaacaaagacuucagcauauuuaguaagggaaaaccaaacuuacacacaauauacuuccgguccuuauuuucgaaagaaaaccucaaggauguaugccucaaacucaacggcgaagcagaaauguucuucagaaaaaaaucaauaaacuaugaugagaaaaaaaaacgagaaggacaucaucccgaacuuuucgaaaaacuaaaauaccccauauuaaaagacaaaagauacucagaggacaaauuucaauuccacuuaccaaucuccuuaaauuuuaagucaaaagaacgucuuaacuucaaccucaaaguaaacgaauuuuuaaagagaaacaaagauauaaacauaauaggaauagaucgaggagaacgaaaccuccuguaucuaguaaugauaaaucaaaaaggagaaauauuaaaacaaacacuacuagacagcaugcaaucuggaaaaggaaggccagaaaucaauuacaaagaaaaacuacaagaaaaagagauagaaagagacaaggcucgaaaaucguggggaaccgucgaaaacauaaaagaacuuaaagaaggauaccucuccauagucauacaccaaauaucaaagcucaugguagaaaacaacgcuauaguaguucuagaagaccucaauaucggguucaaacggggcagacagaaagucgaaagacaagucuaccagaaauucgaaaaaaugcuaauagacaaacuuaacuucuuaguauucaaagaaaauaaaccgacagaaccaggaggggucuuaaaagcauaccagcucacagacgaauuucaaaguuuugaaaaacucuccaaacaaacaggauuccucuucuacgucccauccuggaauacaucaaaaauagacccccgcacaggcuuuaucgauuuucuccacccagcguaugaaaauaucgagaaggccaaacaguggauuaacaaauucgacaguauacgauucaacucaaaaauggauugguucgaguucacagcagauacaagaaaauuuucggaaaaccuuauguuaggaaaaaacagaguauggguaauauguacgaccaauguagagagauauuucacaagcaaaacagccaacaguucaauacaauacaacucaauacaaauuacagaaaaacuuaaagaauuauucguagauaucccuuuuaguaauggucaagaucuaaaacccgaaauacucagaaaaaacgacgccguauucuucaagucauuacuauuuuauauuaaaacaacuuuaagucuaagacaaaauaacggaaaaaagggggaagaagaaaaagacuuuauccuaagcccggucguagacaguaaaggaagauucuuuaacucgcuagaagcaucggacgacgaaccaaaagaugcagaugccaauggcgcauaccacauagcgcucaaaggacucaugaaucuacuuguacuaaacgaaacaaaagaggaaaaccucaguagaccaaaauggaaaauaaaaaacaaagauuggcuagaauucgucugggaaagaaaucgauga

SEQ ID NO: 9266 - RNA, 2820 nt, Artificial Sequence
  Cpf1 variant
augaaccuauacuccaaucucacaaacaaauacucucuuucaaaaacacuccgauucgaauuaaucccacaaggagaaacucucgaaaauauaaaagcacgcggccucauacuagaugacgaaaaaagggcaaaagacuacaaaaaagccaaacaaauaauugacaaauaucaccaauucuucauagaagaaauacucagcucaguauguauuuccgaagaucuacuacaaaacuacucagacguauauuucaaacuaaaaaaaucagacgacgacaauuuacaaaaagauuucaagucagccaaagacacaauaaagaaacacaucagccgcuauauaaacgacucagaaaaauucaaaaaucuauuuaaccagaaccuaauagaugcaaaaaaaggccaggaauccgaccuuauccucuggcuuaaacaaucaaaggacaacggaauagaacuauuuaaagcgaauagcgacauaacagacauagacgaagcacuagaaauaauuaaaaguuuuaaaggcuggacgacuuauuucaaaggauuucaugaaaaccgaaaaaacguauacuccagugacgacauaccaacuucuaucaucuaccguauaguagacgacaaucuaccaaaauucauagaaaauaaagcuaaauaugagaacuuaaaagacaaagcaccagaagccaucaacuaugaacaaauuaaaaaggauuuagcugaagaauuaacauucgauauagauuacaaaacaucagaaguaaaccaacgcguauucucacucgaugaaguauucgaaauagcaaacuuuaacaauuaccucaaccaauccggcauaacaaaauucaauacaauaauuggaggcaaauucguaaacggagaaaauaccaaacgaaaaggaauaaacgaauacauuaaccuguacucacaacaaauaaacgauaaaacccucaaaaaauacaaaauguccguauuauucaaacaaauacuaagugacacugaaucaaaaagcuucguuauugauaaacucgaggacgauucagaugugguuacaacgaugcaaagcuuuuacgaacaaauagccgcuuuuaaaacucucgaagaaaaaucuauuaaagaaacucuaucucuccuauucgacgacuuaaaagcacaaaaacuagaccuaucaaaaaucuacuucaaaaacgauaaaucacuaacagaccuuucacaacaaguauuugaugauuauucagucauaggcacagcaguuuuagaauacauaacacaacaaguagcaccuaaaaacuuagacaacccaucaaaaaaagaacaagaccuaaucgcuaaaaaaaccgaaaaagccaaauaucuaagcuuagaaacuaucaaacuagcauuagaagaauucaacaaauaucgagacauagauaaacaaugcagauucgaagaaauauucgcaucuuuugcagacauccccguacuauucgacgaaauagcccaaaauaaaaacaacuuagcacaaaucucaauaaaauaccaaaaccaaggaaaaaaagauuuacuacaaacaucagcagaagucgacguuaaggcuauaaaagaccuauuagaccaaacuaacaaccuacuccacaaacuaaaaauauuucauauuacucaaucagaagacaaggcaaauauccuugacaaagaugaacacuucuacuuaguauuugaugaauguuacuuugaacucgcaaauauaguagcucucuauaauaaaauucguaacuauauuacgcaaaaacccuacagugaugaaaaguuuaaacuaaauuucgaaaacucuacguuggccaacggaugggauaaaaauaaagaaccagacaacaccgcaauccuguucaucaaagacgacaaauacuaccugggagucaugaacaaaaaaaauaauaaaauauucgacgacaaagcaaucaaagaaaacaaaggagaaggauacaaaaaagucguuuauaaacuacuuccgggugccaauaaaaugcuucccaaaguauuuuucucagccaaaagcaucaacuuuuacaaccccuccgaagacauacuccgcauacgcaaucacuccacacauacaaaaaacggauccccacaaaaagguuaugaaaaacuagaauucaacauagaagauugccgaaaauuuauagauuucuacaaacacucuauaagccgacacccugaauggaaagauuucggauucagauucucagacacaaaaaaauacaacucaaucgacgaauuuuacagagaagucgaaaaccaaggcuacaaauuaacauuugaaaacaucagugaaucauacaucgacucauuaguagaugaaggaaagcuuuaccucuuucaaauauauaacaaagacuuuucaguauacuccaaagguaaaccuaaccuacacacacuuuauuggaaagcacuauucgacgaacgaaaucuccaagacguaguauacaaacuaaacggagaggcagaacuuuucuauagaaagcagaguauaccaaaaaaaauaacccaccccgcaaaagaagccauagcaaacaaaaacaaagauaaccccaaaaaagaaagcauauuugaauacgaccuaaucaaagacaaaagauuuaccgaagacaaauuuuuuuuccacugcccaaucaccauaaauuuuaaauccucaggcgccaacaaauucaacgaugaaauaaaccugcuccucaaagaaaaagccaacgauguccauauacuuuccaucgaccgaggggaacgacaccuagcuuacuacacccuaguagauggaaaaggcaauauaauaugcaaaaauuga

SEQ ID NO: 9267 - RNA, 3795 nt, Artificial Sequence
  Cpf1 variant
augcucuuucaagaguucacacaucuauauccacugagcaaaacgguaagauuugaacuuaaacccauagggaaaacacucgaacacauacaugccaaagauuuucuaucucaggaugaaacaauggcagauauguaucaaaagguaaaagcaauucucgaugauuaccaucgagauuucaucgcugacaugaugagcggaguuguacucaccaaauuagcugaguucuacgaagucuaucuagcucuacgaaaaacuccaaaagacgacucucuccaaaagcaacucacugaaauacagacugcccuucgcaaagaaauagugaaaccaauagguucgggaggaaaauauaaagcaggauacgauaggcuauucggugcaaaacuauuuaaggaugguaaagaauuaggagaucuagccaaauucguaaucacacaagaaggcgaaucuucaccuaaacuagcccacauagcccauuucgaaaaauucuccacauauuuuacaggauuccaugacaaucgcaaaaauauguacucagacgaagacaaacacacagcaaucgcauauagacucauccaugaaaaccucccuagauuuauugauaaucuacaaauucuagcaacaauaaaacaaaaacauuccgcccucuacgaucaaaucguaaaugaacuuaacgcaaauggucuagacguuucccuagccucccaucuagacggauaucauaaacuucucacucaagaagggaucacugcuuauaacacccuccucggcgguauaucaggugaagccggaucaagaaaaauacaagguauaaaugaauuaauaaacauccaucauaaucaacauugccaaaaaucagaaagaaucgccaaauuaagaccacuccacaagcaaauacucucagauggaaugggagucuccuuccucccaaguaaauuugcagacgauuccgaaguuugucaagcuguaaacgaauuuuacagacauuacgcacauguuuuugcgaaaguccaaucacuuuuugaucgauucgacgauuaccgcaaagacggaauuuauguugaacacaaaaaucucaaugaauuaucuaagcaggcauucggagauuucgcccuacuuggaagaguccuagauggauauuauguagauguaguaaaccccgaauuuaacgaacgauucgcaaaagcgaaaaccgauaaugcaaaagaaaaauuaacuaaggaaaaagacaaauucauaaaaggaguccauucacuugcuagccuugaacaagcaaucgaacacuauauagcaggucacgaugaugaaagcguucaagcagguaaacuuggccaauauuuuaaacacggauuagcuggugucgauaauccaauccagaaaauucacaauagccacucaacaaucaaaggcuucuuagaacgagaacgucccgcuggugaacgcgcucuaccaaaaauaaaauccgacaaauccccagaaaugacacaacugagacaauuaaaagaauuacuagauaaugcacuaaaugucguacacuucgcgaaacuauuaaccacuaaaacgacgcucgauaaccaagacggcaacuucuauggcgaguucggcgcauuauacgaugaacuagccaaaauugcaacccuauacaacaaaguaagagacuaccuuagccaaaaaccuuucuccaccgaaaaauacaaacucaacuucggaaauccuacucuauuaaacggaugggaccuaaacaaagaaaaagauaacuucggagugauauuacaaaaggacggcuguuauuaccuagcccuacuagacaaagcacauaagaaaguauuugacaacgcaccaaaugcaggaaaaucaguauaucagaaaaugguauacaaacuucuacccggaccaaauaaaauguuaccaaaaguauuuuucgccaaaucuaaccuagauuauuacaauccaagugcagaacuacuagauaaauacgcacaaggaacacacaagaaaggaaauaacuucaaccuaaaagacugccacgcauuaaucgacuuuuucaaagcaucaauaaacaaacacccggaauggcaacauuucggcuuugaguuuucgccaaccaguucuuaccaagaucuaucagacuucuauagagaaguagaaccucaaggauaucaaguaaaauuuguagacaucaaugcagaauauauagacgaauuagucgaacaaggccaauuauaccucuuucaaauauacaauaaagacuucucgccaaaagcacauggaaagccaaaccugcacacguuauacuuuaaagcccuauucucagaaaacaaccuagcgaauccgauauauaaauuaaacggagaagcagaaauauuuuauagaaaagcaagucuagacaugaacgaaacaacuauacaucgggcaggagaaguacuagaaaacaaaaacccugauaacccaaagaaacgucaauuuguauacgacaucauaaaagauaaaagauacacacaagauaaauucaugcuucauguuccuauaacaaugaacuuugggguacaaggaaugaccauaaaagaguucaauaagaaagucaaucaaaguauacaacaauauaacgacguaaacgucauaggcauugaucgcggagaaagacaucuauuauaucugacaguaauaaauucaaaaggugaaauacuagaacaacgaucacucaacgacaucaucacaacaucagcaaacggaacucaaaugacaacucccuaucacaaaauccuagauaaacgagaaauagaacgucuaaaugcccgaguuggcuggggcgaaaucgaaacaauuaaagaacuaaaaucaggcuaccucucucaugucguacaucaaauaucacaauugaugcucaaauauaaugcuauaguaguacuagaagauuuaaacuuugguuucaagagaggccgauucaaaguagagaaacaaaucuaucaaaauuuugagaacgcucuaaucaagaaauuaaaccaucuugcacuaaaagacaaagcagacgaugaaaucggcucauacaaaaacgcccuacagcuaacaaauaacuucacugaccuaaaauccauuggcaaacaaacaggauucuuauuuuacguacccgcauggaauacuucaaaaauagaucccgcuaccggauucguugaucuuuuaaaaccaagauaugaaaacauagcacaaagucaagccuucuuuggcaaauucgacaaaauauuuuacaaugcugacaaaggguauuuugaauuuuauguagauuaugcuaaauucaccgacaaagccaaaaacucuagacaaacauggguaaucuguagucacggagauaaacgauacguuuacgacaaaacagcuaaucaaaauaaaggagcaacaauaggaauuaacguuaacgacgaacuaaaaucacuuuuugcacgauaccacaucaacgauaaacagcccaacuuaguaauggacauaugccaaaauaacgacaaagaguuccauaaaagccuuauguacuuacucaaggcauuacuagcauuaagguauuccaacgccucuucugaugaagacuucauucuaucaccugucgcugacgacaaaggaguauucuuuaauuccgcucuagcugacgacacacagccacaaaaugccgacgcuaacggggcauaucacaucgcacuaaaagguuuauggcuuuuaaacgaauuaaagaacucaaaugauuuggauaaaauaaaacuagccauagacaaccaaacauggcucaacuuugcacagaauagauga

SEQ ID NO: 9268 - RNA, 3903 nt, Artificial Sequence
  Cpf1 variant
augucaauauaucaagaguuuguaaauaaauacucacuauccaaaacucuacgauucgaauuaauaccacaaggaaaaacccuagaaaacauaaaagccaggggcuuaauacucgacgaugaaaaacgugcaaaggacuacaagaaagcuaaacaaauaauagauaaguaccaccaguucuucaucgaagaaauuuuaaguuccgucuguauaucagaagacuuacuccaaaacuauucagacgucuauuucaaacuuaagaaauccgacgacgauaaucuacagaaagauuucaaaucagcaaaagauacaaucaagaaacaaauaucagaauacauuaaagacucagaaaaauuuaaaaacuuauucaaccaaaaccuuauagacgccaagaaaggccaagaaagugaucuaauccucuggcucaaacaaucaaaagacaacgggauagaacuuuuuaaagcgaauagcgacauaaccgauauagacgaagcacuggaaauaauuaaaucauuuaaaggguggacaacauacuucaaaggauuccaugaaaauagaaagaauguauacaguucugaugauaucccuacaagcauaauuuaccgaauaguagacgacaacuuaccgaaauuucucgaaaauaaagcaaaauacgagagcuugaaagacaaagcaccagaagcuauaaacuacgaacaaauuaagaaagaccuagccgaagaacucaccuucgauauagauuauaaaaccucagaagucaaucaaagaguuuucucgcucgaugaaguuuucgaaauugcaaauuucaauaauuaucugaaccaaucaggaauaacaaaauucaacaccaucaucggcggaaaauucguaaacggagaaaacacaaaaagaaaagggauaaaugaauauaucaaccuauauucccaacaaauaaacgauaaaacucuaaagaaauauaaaaugagcguauuauucaaacaaauuuuaucagacaccgaaagcaaaucauucgucauagacaaacucgaagaugacucagacguagucaccacaaugcaaucauuuuacgagcaaaucgcagccuucaaaacaguugaagaaaaaucaauaaaagaaacgcuaucccuauuauucgaugaccuaaaagcacaaaaacuugaccuuuccaaaauauauuuuaaaaacgacaaauccuuaacagaucucucccaacaaguuuuugacgacuacucaguaauaggaacagcaguauuagaauauauaacccaacaaguagccccuaaaaaucuagacaacccauccaagaaagaacaagaccuuaucgccaagaaaacagaaaaagcaaaauaccuuucauuagaaacaauaaaauuagccuuagaagaguucaacaaacaucgagauauagacaaacaaugccgauucgaagaaauauuagcaaauuucgcugcaauaccaaugaucuuugaugaaauagcccaaaacaaagacaauuuagcacaaaucucccugaaauaccaaaaccaaggcaaaaaggaucuucuucaagcguccgcagaagaagacgucaaagcaauaaaggacuuauuagaucaaacuaauaacuugcuucacagacuaaaaauuuuucauauaagccaaucugaagacaaagccaacauacuagauaaagacgaacacuucuaucuaguauuugaagaauguuacuuugaacucgcaaauauaguaccacucuauaacaaaauaagaaacuacauaacccaaaaaccauauucagaugaaaaauucaaacuaaauuuugaaaauuccacacuagcaaacggcugggauaaaaauaaagaaccagacaacaccgcuaucuuauucauaaaagacgauaaauacuaccucgguguuaugaacaagaaaaauaacaaaauauuugaugauaaagcaauaaaagaaaauaaaggggaaggcuacaagaaaauaguuuauaaauuacugccgggugcaaauaaaaugcuaccaaaagucuucuuuucggcuaaaucuauaaaauuuuacaacccaucugaagauauucuccggauaagaaaccacucaacacacaccaaaaacggcaauccacaaaaagguuacgaaaaauuugaguucaacauugaagacugcagaaaauuuauagacuucuauaaagaaucgauaucaaaacacccagaauggaaagacuucggcuuucguuuuuccgacacccaacgauacaauuccauagaugaauuuuaccgcgaagucgaaaaccaaggauacaaacuaacguuugaaaacauuagcgaaucauacaucgacaguguagugaaucaaggaaaauuauaucucuuccaaaucuacaacaaagacuuuagugcauacucaaaaggaagaccaaauuuacacaccuuauacuggaaagcgcuuuucgacgaacgaaaucugcaggauguaguauacaaacucaacggagaagccgaacuuuucuacagaaaacaauccauucccaagaaaauaacucaccccgcuaaagaagccauagcuaauaaaaauaaagacaacccaaagaaagaaucaguauucgaauacgaccugauaaaagauaaaagauuuacugaagacaaauuuuucuuccacuguccgauaacuauaaacuucaaauccucuggagcaaauaaauucaacgacgaaauaaacuuauuauuaaaagaaaaagccaacgacguacauauauuaucaauagauagaggggaacgacacuuagcauacuauacacucguagacggaaaaggaaauaucaucaaacaagauacauucaacauuauaggcaacgaccguaugaaaacaaacuaucaugacaaauuagcggccauagaaaaagaccgagauagugcuagaaaggauuggaaaaagaucaauaauauaaaagaaaugaaagaaggauauuuaagccaaguaguacaugaaaucgcuaagcuaguaauagaacauaaugcaaucguaguauuugaagacuuaaacuuuggauuuaaacgaggaagguuuaaaguagaaaaacaaguauaucagaaacuagagaaaaugcucauagaaaaacuaaauuaccuugucuuuaaagauaacgaguucgauaaaaccggcggaguacucagagcuuaccaauuaacagcaccauucgaaacauuuaagaaaaugggaaaacaaacaggcaucaucuauuacguaccagcaggauuuaccucaaaaaucuguccagucaccggauucguuaaucaacuauauccgaaauaugaaucaguaagcaaaucacaggaguucuuuuccaaauucgacaaaaucugcuauaacuuagacaaagguuacuucgaguucucuuuugacuauaaaaacuuuggagauaaagcggcaaaaggaaaauggacaauagcauccuuugguucacguuuaauuaacuuuagaaacucggacaaaaaccauaacugggacacacgcgaaguauaccccacaaaagaauuagaaaaacuauuaaaagacuauaguauagaauauggacauggagaaugcauaaaagcggcuaucugcggagaaagugauaagaaauucuuugcaaaacuaacauccguacucaacaccauacuacaaaugcguaauagcaaaacagggaccgaacuagacuauuuaaucucgccuguagcagacguaaacgggaauuucuuugacagcagacaagcucccaaaaauaugccucaagacgcugacgccaacggagccuaccacaucggccuaaaaggauuaaugcuacucgaucgcaucaaaaacaaucaggaagggaagaaauuaaaccucgucauuaaaaacgaagaguauuuugaauuuguacaaaacagaaacaauuga

SEQ ID NO: 9269 - RNA, 3756 nt, Artificial Sequence
  Cpf1 variant
augaaucauaugaaacaauucaccaaucaauuuagccuuaguaaaacauuacguuuugaacucauaccacaaggaaaaaccaaagaguucauagaaauaaauggccuaaucgaaaaagacaaugaacgagcagucucauacaagaaaguaaagaaaauuaucgaugaauaucacaaauauuuuaucgaaaugguacuuugcgacuucaaacugcacggacuagaaacuuaugaaaccaucuuuaacaagaaagaaaaagaugauacugauaagaaagaguucgauaacauucgcaauagucuccgaaaacaaauagcugacgcuuucgcgaaaaacccaaacgacgaaaucaaagaacgcuuuaagaacuuauuugcaaaagaacuaauaaaacaagaucuacucaacuucguagaugacgaacaaaaagaacucguaaacgaguucaaagacuuuacaaccuauuuuacgggauuccaccaaaacagacgcaacauguacguagcagacgaaaaagcaacagcaauagcuuaccgucuagucaaugaaaacuuaccaaaauuuauagacaaucucaaaauauacgaaaagauuaagaaagacgcgcccgaacucauaagugacuugaauaaaacucuaguagaaauggaagaaaucguacaaggaaaaacccucgacgaaauauuuucccucucuuucuucaaucaaacguuaacccaaacaggcauagaacuauacaauauagucauaggaggccgaacagcagaugaaggaaaaacaaaaaucaaaggccuaaaugaauauauuaauacggacuauaaccaaaaacaaacagauaaaaagaagaaacaagccaaauuuaaacaacuguacaaacaaauacuuagcgaccgacauuccgucucuuucgucgccgaaacauuugaaacagaugcgcaauuacuagaaaacauagagcaguuuuacaguucaguacucugcaauuacgaagacgacggacacacuacaaacauauuugaagcuaucaaaaaccucaucaucggauuaaaaacauucgaccuuucgaaaaucuaucuaagaaacgauacaucccucacagacaucagccaaaaacuauucggugacuggagcauaauaucaucugcccucaaugauuauuacgaaaaacaaaauccaaucucauccaaagaaaaacaagaaaaauacgacgaaaggaaagcaaaaugguuaaaacaggacuucaacauagaaacaauacaaacagcccuaaacgaaugcgacucagaaauaauuaaagagaaaaauaacaaaaauaucgucuccgaauauuucgcaaaacuuggucuugauaaagacaacaaaauugaucuuuuacagaaaauacaucauaacuauguuguuauaaaagaucugcucaacgaaccuuaccccgaaaauauaaaacugggaaaccaaaaagaacagguuagccaaauaaaagacuucuuagauucaauauuaaaccuaauacauuuccucaaaccccuaucuuuaaaagacaaagauaaagaaaaagaugaacuuuucuauagccuauuuaccgcucuauucgaacauuuaagccaaaccauaucaaucuauaauaaagucagaaauuaucuaacucaaaaagcauauaguacagagaaaauaaaacuaaauuuugaaaauaguaccuuauugaacggaugggauguaaacaaagaaccgguuaauacaucuguaauuuucagaaagaauggacuguucuaccuaggaaucaugucaaaauccaacaacagaauuuuugaacgaaacguaccaguaugcaaaaaugaagaaaccgcauuugaaaagaugaacuauaaauuacucccaggagcuaauaaaaugcuacccaaaguuuuucuuucagccaaaggcauagaauccuuccaacccagcgcagaaauacagucaaaauaucaaaaagaaacacacaaaaagggugacgccuuuguuagaaaagauauggaaaacuuaauagacuucuuuaaacaaucaauagcuaaacauacagauuggaaacacuuuaaucaccaauuuagcaaaaccgaaacauauaacgaucuuuccgaguucuauaaagaaguagaaaaacaaggauauaaacuaacauucacuaaacuugacgaaaccuacauaaaccaauuagucgacgaagggaaauuauauuuauuccagaucuacaauaaagacuuuuccccuuucucaaaagggaagccaaauaugcauacguuauacuggaaaauguuauucgacgaacaaaaccuucaaaauguaguuuauaaacuuaauggagaagcugaaguuuucuuccgacagaguucaaucaaacaaacugaccggaucauucacaaagcaaaccaagcaauagacaauaaaaauccacuaaauaauaagaaacaauccaguuuuaauuaugaccuaauuaaagauaaaagauucacacuagauaaauuucaauuucaugugccaaucacgcuaaauuucaaagcugaagguaaugaauaccuaaacacaaaagucaacgaauaccuaaaauccaacagugacguaaaaaucauaggacuagauagaggagaacgacauuuaauuuacuugacacucauuaaccaaaaaggggaacuccuaaaacaacaaagccuaaacguaauagccacgucacaagaacacgaaaccgauuacaaaaaccugcuagucaauaaagaaaacgaacgcgcaaacgcaagacaagacuggaaaacaauagaaacuauaaaagaacuaaaagaaggcuacuuaucacaaguaguacaucaaaucgccacaaugaugguagaugaaaacgccaucguagucauggaagaucuaaaugcagguuuuaugagaggacgacaaaaagucgaacgacaaguuuaccagaaacuagagaaaaugcuaauagaaaaacuaaacuacuuagucuucaaaaauaacgacguaaaugaaacagccgguguucuuaacgcacuucaauuaacaaauaaauuugaauccuuugagaaaaugggaaaacaaucuggauuuuuauuuuacguaccagccuggaauacaaguaaaauagacccagcaaccggcuucguagacuuccucaaaccuaaauaugaaucuguagaaaaagcaaaauuauuuuucgaaaaauuugaaucaauaaaauuuaacgccgacaaaaacuauuucgaguucgaauuugauuauaagaaauucacugaaaaagccgaaggaucccagaccaaauggacaguauguacacacagugauguaagauauagguacaauccucaaaccaaagcaucagacgaaguaaacgugaccaaugaauuaaaacuaauauucgauaaauuuaaaauagaauacaaaaacggcaaaaaccugaaaacagaacuacuacuccaagacgacaaacaacucuuuuccaaacuucuacacuaccucgcccuaacccuaaugcuacgacaaagcaaaagcggaaccgacauagacuucauacucucuccaguggcuaaaaauggaguauuuuacgacuccagaaacgcaaugccaaauuuaccaaaagacgccgacgcaaauggagcauuucacauugcacucaaaggguuauggugcguccaacaaaucaaaaaggccgaugaucucaagaaaauaaaacuagccaucuccaauaaagaaugguuaucauuuguacaaaaucuuaaauga

SEQ ID NO: 9270 - RNA, 4173 nt, Artificial Sequence
  Cpf1 variant
augauagauaauacaaaagaaaagaaagaagggaguguguucgacggauucacaagaaaauaccaacuaucaaaaacucucagauucgaauuacgcccaauccuuaacacaccuaaaaugcuagacgacgaacaaguaaucaaaaacgacgaaacacggcgcaagaaauaugaagcaguaaaaccaugguucgaucaacugcacagggaguucauagaagacgccuuaaaaucauucaaauuuaaaaaucuagcaaucuaccaagauacauuccaaacuuggcaaaaagauagaaaaucaaaacagaagaaagauacccuagucaaaauagaagucggacucagagaagaaauagucagaagguuugaagaaguagccaauauauggguuagaucagaacaauacaaacuuuuaggcaucaagaaagaaggauuagguaugcuauucgaagcagggguauuuagauuguuaaaagaaagauucaaaaacgaaaaagacacaaccguagacggaaacaacauauucgacgaauggacgagauggacgggauacuucaagaaauucuuugaaacacguaaaaacuuuuacaaaagugacgacaccucgacagcuaucgcauacagaguaauaaaccaaaaucugagacguuuuugugaaaauauacaaauuuucgagaaaauuucagagaaaaucgaauuuucggaaguagaaaaauccuuugacauuucaugcgcagggauauucagccuagcguacuacaacgcaugccugcuucaagggggaauugacacauacaauaaaauaaucggcggugaagucgaugaaaaagacaagaaaauaccuggaaucaaugaauuaauaaacaaauaccgacaagacaacagcggugaaaagauaccauuccucaaacaacuggauaaacaaauucacucagcaaaagaagccuucauagaaucaauagaaacgaauaaagaacuugugggaaaacuaaaaacauuuuacgaaaaugcugaagucaaaauacaaaguuuuagaaaccucauagcggauauagugaccgauuacagcgguuacgacauugacaaaauauaucuaaccaaagaagccguaagccauaacgcuaguagaugguucgcuagcuucgaaucauucgaacgugauuuguucgcuguagucgcagaaaaacaaaacaaacuuguuuacgaauuacuuagaacacacaaaaaugacucaaaaauuagugauaaagaugguaaauuuuccuuccccgacuucauaaaaugcucgcauauaaaaagagcccuagaaaaacaggaaggaagaauauggaaaggagaauacuaugaagacaucguagacuuugaaaagauaaaagauguauuuacacaguuucuauguguuuuuaaauucgaacuagaacaacaauucuucagaaaaacaacuagcgcgcagacaggugaacaaacaaaaauuggauacgaaaucuucguaacaaaaauaaaugaauuaauaacgagggaaaaucccgugaucgacuuagaagaaaagauagcuaucaaaaacuuugccgacgcaacauuacucauauaccaaauugcaaaauauuucgcaguagaaaaacgacguggauggcuggauaacuacgacuuagacgauagauucuauaaaucaucugauauaggauaccucaauuucuacagagaugccuuugaacagauaguccggccuuauaaccuauuuaggaauuaucuaaccaagaaaccuuauaacacuaacaaauggguauuaucauucgaaaacccaaccuuagcagacggaugggacaaaaacaaagaaaagacaaacgccgcgguaauacuacgaaaagauggccgauacuaucuaggaauaauuaaagaagauugcaaaagucuguucgcugacagauacaguaaagaaaugagcgaagguauugaaucagguagcuuccagaaaauggcauauaaauucuuccccgaagcaaguaaaaugauaccaaaauguaguacccaaacgaaaaacguaaaagaacauuuuagaaaaucaagcagcgauuacaaccuauuucacgaaaaagauuacaaaauaucagucgcuauaaccaaaaauauuuacgaacugaacaauguauuuuauagaaaagauaauaucgaagaaucauucguaccuaaaaaugauuucgaaaagaaacuuggaguuaagaaauuccagcgacaauauuuggaaauaaguagggacaacaacggauauaaacaagcccucgcucaguggauugaauuuuguauaagauuucuuaaagcauacaaaucaacaacaauauucgacuauaguaggcuaagagaagcaaaagaauaugaaucacuugacgcuuuuuaccaagacauaaacgcauugacauauaauaucucauucguaccgauaucggaacaauacauaaaagagaaaaaugauaacggagaacuauuucuauuugaaauauauaacaaagacuggagcuuaggaccuauggauaaaaacagaaaaagaacuaaaaaucuacacacacuauacuucgaacaauuauuuuccaaggaaaacgaacaagaaaacuuucucuuucaguuaaacggagaagcagaacuauucuucagaccaaagacggaagagaaaagacuaggauacaaaguaugggaugcaggagagaagaaaugggugaaagcaaaagaaaaagaagacggggcagucauagaucgaaaaagguaugcaaaagacauuauacuuuuucacugccccauaacacuuaacagaguguccgaaucgaagacaaaaagagaaauggauguagaaauuagagaaguacuaucaagcaccccaggcguacacauaauaggaguggacagaggcgaaaaacaucucgcuuauuauucaguaaucgaucagaauggaaaaauaaucgaaacagauaccuuaaacucaauaggaaaagacggacgcggcaagcccguagaauaugcaucaaaacucgagaaaagagcacaagaaagagaagccucucgaagagacugggaagaagucgaagcaauaaaagaucuuaagaaaggcuauauuagucaaguaauaagaaaucucgcagaucuaauaauaaaacauaaugccauaaucguuuucgaagaucuuaacaugcgguucaaacaaauaagaggaggaaucgagaaaagugcuuaccaacagcuagaaagagcauuaauagacaaacuaucauuucuagucaagaaaggcgaagaagaccccaaacaaacaggacauauauuacgcgcguaucagcuagcagcaccagucauugcauuuaaagauaugggaaagcaaaccggacuuauauuuuauacacaagcaggauacaccaguaaaacauguccggaauguggguacagacgaaauauaaaaugucuauucgagaacauagaacaagcaaaaacucucauagaaaauuuagaauccauuaauuacaauaagaaagaagauguauuucaaauaagcuauagccuagagaaauuaucauccaaagaccagaagaaagagaagaaagugagcaacgaacuuuaugccaaaacguuaaagaaagauaucuucauccucacuacgaaaaaugcacuuagauacaaaugguacgacagguacucagaaaaagcuaaaguagcaaaaaggggaauagacgaauacaaaggugaaguaaaugagagcgaaaccaagaaaggaguaguuaaagaguucaaucuaaccgaauacuuaaaaggacuacuaaaaacauaugagaucgacuaugagcaugggggaaucagagaacagauccuaucuguagcacgaggucgagaauuuuacaaagacuuucuuuacgcguuauuccuucuuaccgaaacaagacacucaauaucagguagaaacacagauuauauacaaugcccugaaugcgaauuugauucaagaaaagguuucaaggauauaaaagaauuuaacggcgaugccaacggagcguauaacauagcuaggaaaggcauaaugauauuagagaaaaucaaacaguuuaagaaagauaaugacggaaauuuagagaaaaugggauggggcgauuugucgauaucaauagaagaaugggauaaguucacccagaaagaauga

SEQ ID NO: 9271 - RNA, 4026 nt, Artificial Sequence
  Cpf1 variant
augaacgcagaaaaaaaaugcgccuucaaugaauucacaaacuuauacgaauuaaguaaaacguuaaaauuugagcuuaaaccuguuggaaagacaaaagaaaucaucaaaaacuuccgagaagaacuugaaaaaaacaaucccauacaauuagacaaagagauuuccauagcaaaacaggaaauuaagaaagaccuagauauccuacacagagaauucguuagacaauccuuugaauuggcauucaaagaaaacaaaauaaacuaugaaauauuuuucgaaauauaccgaaauuucaagaaauuuucaaaaaacaaaaaaucagacgaauacauugcggcuaucaaaaaccuaaaagaagaaaaaauaaagcuagucaaaaaaauagcagacuacuucgucaaaauggaccaagaauggcgcaaauauuaccccagcgaaaaaaaaagcuuccucuuaaugagcaauggcguuaucaaucuacuuaucgauaucaauaaagacagaauggauuacucauucauacccaaagaaguuugcgaaaagauuaaagguaaaggcaaaauagaacuauacgaaaaauuuaacaaacauuucggauaucucucaaaauauaacacggcaagagagaauuuuuacagugacgacgucaaaaacagcgcaaguguugcauacagggccauaugcgagaacuuagaaaaauuuugcgacaauaagauuaaaguagaagcggacaacuuuccuaaagaaauaaaagaaaaauuucuagaauauuuuaauaaaauuaccgaucuaucauucuacaauagaugccuaagccaaaacggaauagaggaauaucauaaauucaaagaugaaauaaaucgaaguauaaaugaauuauaccccaacaauagcaaaaacaaaccccaaaacauaccauaucuuucuaaauuagacaaacaaauacuaucagaaaaagacaaacaguccuggauagaagaaggcuuuauagaugaaaauaauuucauuuuugaauucgaaaaauuuauaaaaaugaaugauaaauacauaccaagcgaaaaaaaacuauuuaaugaauucuucauauuccaaaacaacgacgaaguccuccaaaaauuauuccuacugaagaaaacaauaaacaauuuugccaacauauaucucgacgaccccaaaaaucuaauggaucuuaugccaucaaaaggaaccaaaaagagagauuauuuaucccugcuagaaauuaaagaagcucuuaacucauacgcugaaaaccaaaacauaggcgaaacucagaucuuuaaaauaaaauacgacgacgugauagacaaaacaaaaacccccuuugaaugcuucaugaaaauuuggaaauacgaauaugaccuacuuuauaacgaaggcgauggaaagaaaaacaucgaagaaggcugggagaaaauaugcgaaaagcuucaaaauaaaaaggacgaauucaccggagacuacggaaaauauaaaaaagaaauaaaagacuauugcgaaauggcgcucuccuuaagucaaagaauuaagcaccuagauauacgcauuaaaaaaagagauggauccgaagacgcagauaacaaucuuuucgaaggaguagaaaaacuagacgaauucuaugaucgguuauucgaaauaguagacgaacauaacgcauaucaauaccaccacgaauuucaagcauuccuuacgaaaaaaccguauaaaacagauaaauucaaacuaaguuuugauaacccgcaauuacuaaaaggaugggaccuaaauaaagaaccugauuauuuuggcgcacuucuagucaaaaaugaaaaauacuucuuggcugucuuucauaaacaauaugcaaacgaaauuuuccgacaaaagaacaaaaauagcacagucaaaaucaaagaggccuacgauguauucaacggcaacuauuauaaaaaaguugagcucaaacaaauaccaaaacuguuuaugaaccucccaagaaucuguuuugcaaaaucaaaucaagaagaguucggacuaacaauugaauuagaaaaaauaaaaucagaauucgacaaauuccaaaaacuuaaaaaagaaagacaagacaacaaccuuaaauuugaucaagaaaaauucauaaaacucuuagcauacuauagacacuguuuagaaauaagagaagauuggaagguauuuaaauacaacuuuaaaccuuuauacaaguauaguaauuuaggagaauuuuauagagacuuagagaaagauacauauaaucuagaccucguucgagucaauucagaauaugucgaaaaaaaacggaacgagggaaaacuauauuuauucgaaguuuacaauaaagacuuuagcgauaagucaaucggacggaagaacauucacagugauuauuuuaaaagccucuuccuaccagacaaccuaacgaauaaaaaaaucgcauuagccgcagacgcggaaauauucuucagagaaaaaagcuuaaaaaauaaagacgaaauaauaacacagaaaaacaaaauaaaaauagacaaaaauaaccacaaaggagagaaagcuuauaguaaaaaucgauauacagaugacaaaauaauacuccacuugccaauaaaccuaaacuucggcgaaaacaaaaaccacaaagauuucaacuacgaaauaaaugauagccuauuaaaaaacaacagggacauaaaaauaauaggaauagaccgcggagagaaauacuuacuguacuacucaguaauagaucaaaaaggcgacauaaaagaaaugggagacuuuaacguaguaaacggaguagauuauuacuccaaauuaguagcauaugaagagaaacgcaaacaagcccgucuagacuggggagacauccaauccauuaaagaacuaaaagaagguuauauuagccauguuauacacgagauaugcgacuuaauuaaaaaauacaacgcaauaguagucuuagaagacuuauccauggguuuuaaaagaggaagauucuucagagaaagacaaguauaccaaaaauuugaacuagcucuauucagaaaauuaaacuacugggucgacaaaaauaaagaagagggggaaaaaggaagugcccuaagcgcuuggcaacuuacaccgaacgaaaaagacuuuaaaguaagccaacuggagaaagcccgacaacugggcauacuauucuacacagcugccggauauacaaguaaaaccugcccagacuguggguuuagaaaaaacauaacauugaaauacguuaacgacaaacaauuaaaagaagaucucggcaaacucaaaauuaacuucgucgaagaccauuucaaaauaaaauauaaucuauuagacuuugaaaaaaacaaaaaaucagaaaaagcuaaagacacuguacucccaaaagaggaacgaaaaauuucuuuuguggcaaauucaaaaguaauccgaauacgcuggcacgauauuaaaaccaaacuugcuaaacgagaauuagacggagaaaaaauaauuaaaaaguucccaaaaggaguaaucaaagaauacgacauaaauauaugcuuaaaaagaauuauuggagauaaaaucgacuuuagcaaggacucaaucacagaacaauuaauaaauggaagauucggaaaagauuuuuacugggaguugauguacuuccuaaaucuaauccucgaaaucagaaauguagugagcgaaacagaaauagacuacauccaauguccagucuguggauuccacuccgaugauggcuuucgaggaaauaaauucaacggagaugcaaacggagcguauaacauagcaaggaaaggaagacuaauauuagagaaaauaaaccaacacaaaaaucucaaggaacuaaagacgggagaucuaucggucaauauaguugaaugggauaaagccguuaacaauugggacaaauuuguccaaggagauaacacugaaagcaaaaauauagaaauaccagcaaaagaagaaaugauauccgucgaagucagagagaguuga

SEQ ID NO: 9272 - RNA, 4107 nt, Artificial Sequence
  Cpf1 variant
augaaaaaagaaaaagaauucaaaucauucggcgacuuuacaaaucuauacgagaucaguaaaacgcuacgauuugaacuaaaacccguugaaaauacccaaacaauguuagacgaagccgacguauucggaaaagacaaaguaauuaaagacaaauauacaaaaacaaaacccuucauagacaaacuacaucgggaguucguugaugaaucauuaaaagaugucucgcuuagcggcuuaaaaaaauacucggaaguacuugaaaacuggaaaaagaacaagaaagacaaagauauugucaaggaacuaaagaaagaggaagaacgacugagaaaggaaguuguagaauucuuugauaauacagccaagaaaugggccaacgaaaaauacaaggaauuaggauuaaaaaaaaaagacauaggaauccuauuugaagaaucaguguuugacuuauuaaaagaaaaauacggugaagaacaagacaguuuccuaaaagaagaaaaaggagacuuccuuaagaacgaaaaaggcgagaaaguaucaauauucgacgaauggaagggauuuguaggauauuuuacaaaauuucaagaaacuagaaaaaacuucuauaaaaaugaugguacagagacagcauuagcaacaagaauaauagaccaaaacuuaaaacguuuuugugacaacauagaugacuucaaaaaaauuaaaaacaaaaucgauuucucagaaguggaaaaaaauuuuaacaaaacagcagauguuuucucucuagacuuuuacaaccaaugcuuauuacaaaagggaauagacagcuacaaugaguucauagggggaaaaacacuugaaaacggaaaaaaauuaaaaggagugaaugaguuaguaaacgaauaucgacagaaaaauaaaaacgaaaaaguaagcuuuuuaaaacucuuagacaaacaaauauuaagcgaaaaagaaaaacuuucauucggaauagaaaaugaugaacaacuauuaguuguacuaaacagcuuuuaugagaccgcagaagaaaaaacgaaaauacuuagaacauuauuuggggauuuuguugaacacaacgagaauuaugaucuggacaaaacauacauaucaaaagucgcauucaacacaauaucacauaaauggacaaacgaaacgcacaaauucgaagaacuccuauacggagcaaugaaggaagacaaaccuauuggacugaacuacgauaaaaaagaagacagcuacaaauucccagacuucaucgcccuaggcuaucuaaaaaaauguuugaauaaccuagauugugauacaaaauucuggaaagaaaaauacuacgaaaauaaugcugacaaaaaagauaaagauaaaggauuucugacuggaggccaaaacgccugggaucaauuucuacagauauucauauucgaauuuaaccaacuauucaacucggaggcauucgauaauaaaggaaaagaaauaaagauaggcuaugacaacuuucgaaaagacuucgaagaaaucauaaaccagaaagacuuuaaaaacgacgaaaacuuaaaaauugccauuaaaaacuucgcagauagugucuuauggaucuaucaaauggcaaaauacuucgcuauugaaaagaaaagaggaugggacgaugacuucgaacuaagugaauucuacacaaauccaagcaauggguauagucucuuuuaugacagggcauacgaagaaauuguacaaaaauacaaugacuuaagaaacuacuuaacuaagaagccauacaaggaagacaaauggaaauugaacuuugaaaaucccaccuuagcaaauggguuugauaaaaauaaagaaagugacaacagcacaguaauauuaagaaaaaaaagaaaauauuacuuaggguuaaugaaaaaaggaaacaauaaaauauucgaggacagaaauaaagcugaauucauacgaaauauagaauccggagccuaugaaaagauggcauacaaauaucuaccugaugucgcaaaaaugaucccuaaauguagcacccaauuaaaugaagccaaaaaucauuuuagaaauagcgcagacgaucuagaaauaaaaaaaaguuuuaguaauccacuaaaaauaaccaaaagaauuuuugaccucaauaacauacaauaugacaaaacgaauguaagcaagaaaauaucgggcgauaacaaaggcauaaaaauuuuucaaaaagaauauuacaaaaucucaggagauuucgacguuuacaaaucagcacuaaaugacuggaucgacuuuugcaaagacuuucuuuccaaauacgauuccacaaaagacuuugacuucucuauauuaagaaagacaaaagacuacaaaucacuugacgaauucuauguagauguugcaaagauuacauacaaaauaaguuucacgcccguaucagagucauauauugaccaaaaaaauaaaaacggugaauuauacuuguuugagaucuacaaucaagacuucgcaaaaggaaaaaugggggcaaaaaaccuacauacucuauauuucgagaauguauucucgccugaaaauauaaguaagaacuuuccgauuaaauugaacgggaacgcggaauuauucuuucgaccgaaaucaauagaaucuaaaaaagaaaaacguaacuuuguacgggaaauaguaaacaaaaaaagauauucagaggauaagauauucuuccauugcccaauuacacucaaucgagagacagggagcauuuauagauucaacaacuacguuaauaacuuucuaagcgaaaacaacaucaacauaaucggcguagacaggggugagaaacaccucgcauacuauucagucauagacaaaaacggggucaaaauaggaggcggaucuuuuaacgagauaaauaaaguugauuaugcaaaaaaacuagaagaacgcgcaggagaaagagaacagagucguaaagacuggcaagugguagagggcaucaaagaucuaaaaaaaggauauauaagucagguaguuagagaacucgcagaucuugcgaucaaacauaaugcgauaauaguauuagaagaccuaaauaugagauucaaacaaauuagagggggaauagaaaaaagcauauaccaacaauuagagaaagcgcuuauagacaaauuauccuucuuaguggaaaagggcgaaaaagacccaaaccaagcgggccacauauuaaaagcguaccaacuagcagcaccauuuacaucauucaaggacauggggaaacaaacaggaauaguauucuauacccaagcaucauauacaucaaaaaccuguccaaacugcggauuccgaaaaaacaacaacaaguuuuacuuugaaaauaauaucggaaaagcucaggaugccuuaaaaaaacuuaaaacuuucgaauaugacuccgaaaacaaauguuucggguuaucauauugcuuaagcgacuuugcaaauaaagaagaaguagaaaaaaacaaaaacaaaaaaagaaauaaugcgccauacuccgauauagagaaaaaagacugcuucgaacuaucaacuaaagaugcaguacgauacagguggcaugacaaaaacaccgaaagaggcaaaaccuucuucgaaggugaaagcguauacgaagagaaagaagagaaagaaauuggacaaacaaaacgaggcuuaguaaaagaauacgauaucaguaaaugucuaauagggcucuucgaaaaaacgggacuugacuauaaacagaaucuguuagauaaaaucaauaguggaaaauucgaugguacauucuauaaaaaucuauucaacuauuuaaaucuacucuucgaaauuagaaauagcauaagcggaaccgaaauagauuauauaagcugcccagaaugccaauuucacacagacaaaucaaaaacaaucaaaaacggagacgacaacgggagcuauaacauagcaagaaaaggcaugauaauacuagauaaaauuaagcaauucaaaaaggaaaauggaucacuagacaaaaugggcuggggagaacuguucauagacuuagaagaaugggauaaauucgcacaaaaaaagaacaacaauauuaucgacaaauga

SEQ ID NO: 9273 - RNA, 4149 nt, Artificial Sequence
  Cpf1 variant
augucgaaaaauaaugugugggauaaauuuacaaaucaauacucauuauccaaaacacuaagauuugaacuaaaaccaguaggaaaaacacgggaaaaaaugaacgaacaacugaaauacgacaaacaauuacaaacauuccuaaaagaccaggaaaucgaagacgcauaccaauauuuaaaaccguuuuucgacaaacuccauaaagaauuuauuacagacagccuggacuccgacacaaccaaaaaaauugacuucucagacuaucuaauagauuauagagauaaaaaagauuuaacaaaaaaagaggacucacuaagaaaaaacauaggcgaaguauuuguaaaagcaggagacagguggaaaaaggagaaauacccgaaguaugaauggaagaaaggcagcaacguagcuaacgguucaggaauacuacugacgcaagaugugcuaaugcucauuaaagauuuaaaucccaacgaucaaaaaaucaagaaaaugaucgaagaaaccuucaagggcuuuuuuacuuacuuuucaggcuuuaacuuaaauagggaaaacuauuacacgaccaaaguagaaaaagcaacagcaguagcaacaagaauaguacacgauaacuuacccaaauuuugcgauaaccuaguacaauuugaaugcaucauaaagaaaaaaaaaaacggcgaaguagaucgcaucgaaagaaaaagcgaauaccugaaugcauaccaguauuuaaaaucaaaaggacgaacuacucaaauaaaagacgcugaaucggggaaaaugauagaagcagaaguuauaaacgaaaacauguuuaguauaaguuacuucucagcuuguuuaagucaaucaggaauagaagaauacaaucggacuaucggacacuacaaccuguuaauaaaucuauauaaucaagcgaaagaaggggaagaaaaggaccuaaaaaaaucagaaaaaaaauucaaaagacuuccgauauucaaaacccuauacaaacaaauuggauguggagaaaaagaaccacucuucuuuucauuaacccacgauacuaaauuacaaguucaagagaacaaagaaaacuauaagaaaccauauagcguggaacaaauacuagaacaggcaaaauuagcaggcgacaaauauuucaaaggaaaaucgaacgacggaauauuaaauaccauuccagaauucucagacuacauacugcaaaaggaaucauauggcggcguauacuggucaaaaguugccauuaauacgaucucaaaucgcuacuucgaaaauuggcauacguuaaaagaugcauuaauagacgccaaaguauuugaaaaaggaaaaaagggagaugaagaagacgucaaaauuccagagucaauagaacuacaaggcuuuuucgauguauuagauacacaggaaggauggaaaucggaaggcauauucuucaaaaaaagcuuaaccgaagaacuuaaaaauaaggaagcagacacuaagaacaaaaaaagaagggaaaucguaaaagaagccaagagacccucccaagcccuuuuagcacucuuauucgaugacauacaagaacacgcaaaccuauucuugaaucaaagcgaugaaauauuaaaguuagagaaguauagcgaaaaggaaucaaaagaaaaaauaaaacaauggauggacucagcauuggcagugaaccgcauauugaaauauuuuuuugucaaagaaucaaaggccaagggagaacaaauagaucccauaauaagcgaggcauuaaaaguauuauucaauucagaagacgcuacgugguucaaaugguacgaugcacuucgaaacuaccucacgaaaaagccacaagaugaugucaaagaaaauaaauuaaaacuaaacuucgagaauuccacauuagcgggagggugggacaucaacaaagagucggauaauuacugcguuauacuucaagaccaaaaagggaaacaacaccuagguauaauugcaaaaaaggaaaagcaaagggguuauaacaaaauauucgaacgaacuccugaaaacccacuuuacaaaauagauuccggagaaguauggcaaaaaauggaauacaaacaaauagcagucccaaccggaauaggaggauucguucgcaaaugcuucaauacagcacaacaauacggguggaaauguccagauaauugccuaaacucagaagguaaaauaauaauaaaaaacgaugaggcaaaggaaaaccuagaagcaauaauagacuguuauaaagacuucuucacaaaguaugaaaaagauggauucaaauauaaaaacuuuaacuuuaacuuuaaagagucagaagaauacgaagaacuuaacucguuuuuuucagacgucgaacgacaaggauacaaauuaggcuuuauaacaguaaacaagacaauaauagauaaauggguugaagacgguacaauuuaccuuuucgaaauaaaaaaccaagacacaaaugauggcaaaaaagacggacacaaaaacaacuugcauacaauauacuggaaagccuuauuugaagauguaggaaauaaaccaaaauuaaauggaggagcagagcuguuuuacagaaaagcguuauuaaaagauaaacaagaaaaaaucgaagacaauuauggaaaagaaaucauaaaaaacuucagauucucaaaagaaaaguuccuauuccacugcccgauaaaauuaaacuauaaagcaaagucauauagucauccaaaauaugcacuccccgagaucaauaaacagacaaaugaauucuuuauaacuauuagugacauuuguuuucuuggcaucgacaggggagagaaacauuuagcauauuacagccugguaaaccagaaggaagaaaucauugaucaagguacucuaaacaugccauuuguugacaaagacggaaagccaaggucuaucaaaaaagaaaaguuccgguucgaugcaaaaguagacaaaugggucuccgaggaaauggacuguuggaacuauaaugauuuauuagacgcaauggcuucaaaucgagauauggcucgcaaaaacuggcaaaccauuggaacaauuaaagagcuaaaaaacggcuauauaucccaaguggugagaaagauaguugacuuagcaaucgauaagaacagaggaauaccaagcuuuauaguacuagaaaaccuaaacgcaggauuuaugcgaggaaggcaaaaaauagaaaaaagcguauaccaaaaacuagaacuugcacucgccaaaaagcuaaacuucguaguugauaaaaccguacaaaacggugaaauaggaucagugaccaacgcucuacaacuuacucccccugucacgaacuuucaaaauauugaaaaucgcaaacaaguuggaaucaugcuguauacuagagcugacuacacuucgcaaacagaucccguaacaggauggagaaaaagcauuuaucuaaaaaaagguagugaagaauacauaaaaagccagauuauggauaguuucgaugacuucggauuugauggcaaaaacuauuacuuuaaauacacaguagaucuuaucgauccgaucaaaaaaacaagugaaaaaaaauucaaaaaacaauggacacuuuauagcggcauuaacggaaagagccuagacagauuccggggagagagaucaucugauaaaaacguauggaucaaaacccuacaagacauuaaaaccaccuuagaugcagucuuuauaggauucgaccuacagcauucacuacgaucacaaauaaucaacgauggaauaaugccgaaaaaaauagagaacagucaauuuacagggugggaaagcuuaagauuugcaauagaaaugauacaacagaucagaaacauaggagucgaaaaaggagacgaagauuucauauuaucaccaguaagagacaaaaaugagaaccauuuugacagccgcaaagcaaaagaaaacgaaccaaacucgggggacgcaaauggagccuauaauauugcgcgaaaaggaauuauaaugaacgaacacauuaaaaaagaccuaauaccauucauacaagacaaagaaugggaugccuggcucgcuggaagggaagucugggacaaguggcuuauugaaaacaaagacucauuaauauacaaaaaauga

SEQ ID NO: 9274 - RNA, 4203 nt, Artificial Sequence
  Cas9 variant mRNA product
auggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauga

SEQ ID NO: 9275 - RNA, 4986 nt, Artificial Sequence
  Cas9 variant mRNA product
auggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguga

SEQ ID NO: 9276 - RNA, 3258 nt, Artificial Sequence
  Cas9 variant mRNA product
auggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauga

SEQ ID NO: 9277 - RNA, 4326 nt, Artificial Sequence
  Cas9 variant mRNA product
auggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauga

SEQ ID NO: 9278 - RNA, 3402 nt, Artificial Sequence
  Cas9 variant mRNA product
auggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauga

SEQ ID NO: 9279 - RNA, 4263 nt, Artificial Sequence
  Cas9 variant mRNA product
auggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauga

SEQ ID NO: 9280 - RNA, 3345 nt, Artificial Sequence
  Cas9 variant mRNA product
auggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauga

SEQ ID NO: 9281 - RNA, 4101 nt, Artificial Sequence
  Cas9 variant mRNA product
auggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauga

SEQ ID NO: 9282 - RNA, 4134 nt, Artificial Sequence
  Cas9 variant mRNA product
auggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauga

SEQ ID NO: 9283 - RNA, 3267 nt, Artificial Sequence
  Cas9 variant mRNA product
auggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauga

SEQ ID NO: 9284 - RNA, 3345 nt, Artificial Sequence
  Cas9 variant mRNA product
auggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauga

SEQ ID NO: 9285 - RNA, 3351 nt, Artificial Sequence
  Cas9 variant mRNA product
auggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauga

SEQ ID NO: 9286 - RNA, 3051 nt, Artificial Sequence
  Cas9 variant mRNA product
auggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauga

SEQ ID NO: 9287 - RNA, 3462 nt, Artificial Sequence
  Cas9 variant mRNA product
auggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauga

SEQ ID NO: 9288 - RNA, 4020 nt, Artificial Sequence
  Cpf1 variant mRNA product
auggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauga

SEQ ID NO: 9289 - RNA, 3999 nt, Artificial Sequence
  Cpf1 variant mRNA product
auggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauga

SEQ ID NO: 9290 - RNA, 4716 nt, Artificial Sequence
  Cas9 variant mRNA product
gggagagucccgcagucggcguccagcggcucugcuuguucgugugugugucguugcaggccuuauucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9291 - RNA, 5499 nt, Artificial Sequence
  Cas9 variant mRNA product
gggagagucccgcagucggcguccagcggcucugcuuguucgugugugugucguugcaggccuuauucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9292 - RNA, 3771 nt, Artificial Sequence
  Cas9 variant mRNA product
gggagagucccgcagucggcguccagcggcucugcuuguucgugugugugucguugcaggccuuauucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9293 - RNA, 4839 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9294 - RNA, 3915 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9295 - RNA, 4776 nt, Artificial Sequence
  Cas9 variant mRNA product
gggagagucccgcagucggcguccagcggcucugcuuguucgugugugugucguugcaggccuuauucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9296 - RNA, 3858 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9297 - RNA, 4614 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9298 - RNA, 4647 nt, Artificial Sequence
  Cas9 variant mRNA product
gggagagucccgcagucggcguccagcggcucugcuuguucgugugugugucguugcaggccuuauucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9299 - RNA, 3780 nt, Artificial Sequence
  Cas9 variant mRNA product
gggagagucccgcagucggcguccagcggcucugcuuguucgugugugugucguugcaggccuuauucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9300 - RNA, 3858 nt, Artificial Sequence
  Cas9 variant mRNA product
gggagagucccgcagucggcguccagcggcucugcuuguucgugugugugucguugcaggccuuauucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9301 - RNA, 3864 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9302 - RNA, 3564 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9303 - RNA, 3975 nt, Artificial Sequence
  Cas9 variant mRNA product
gggagagucccgcagucggcguccagcggcucugcuuguucgugugugugucguugcaggccuuauucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9304 - RNA, 4533 nt, Artificial Sequence
  Cpf1 variant mRNA product
gggagagucccgcagucggcguccagcggcucugcuuguucgugugugugucguugcaggccuuauucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9305 - RNA, 4512 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9306 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9307 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9308 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9309 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9310 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9311 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9312 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9313 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9314 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9315 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9316 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9317 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9318 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9319 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9320 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9321 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9322 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9323 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9324 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9325 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9326 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9327 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9328 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9329 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9330 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9331 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9332 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9333 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9334 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9335 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9336 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9337 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9338 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9339 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9340 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9341 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9342 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9343 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9344 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9345 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9346 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9347 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9348 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9349 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9350 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9351 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9352 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9353 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9354 - RNA, 4420 nt, Artificial Sequence
  Cas9 variant mRNA product
gggagagucccgcagucggcguccagcggcucugcuuguucgugugugugucguugcaggccuuauucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9355 - RNA, 5203 nt, Artificial Sequence
  Cas9 variant mRNA product
gggagagucccgcagucggcguccagcggcucugcuuguucgugugugugucguugcaggccuuauucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9356 - RNA, 3475 nt, Artificial Sequence
  Cas9 variant mRNA product
gggagagucccgcagucggcguccagcggcucugcuuguucgugugugugucguugcaggccuuauucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9357 - RNA, 4543 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9358 - RNA, 3619 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9359 - RNA, 4480 nt, Artificial Sequence
  Cas9 variant mRNA product
gggagagucccgcagucggcguccagcggcucugcuuguucgugugugugucguugcaggccuuauucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9360 - RNA, 3562 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9361 - RNA, 4318 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9362 - RNA, 4351 nt, Artificial Sequence
  Cas9 variant mRNA product
gggagagucccgcagucggcguccagcggcucugcuuguucgugugugugucguugcaggccuuauucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9363 - RNA, 3484 nt, Artificial Sequence
  Cas9 variant mRNA product
gggagagucccgcagucggcguccagcggcucugcuuguucgugugugugucguugcaggccuuauucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9364 - RNA, 3562 nt, Artificial Sequence
  Cas9 variant mRNA product
gggagagucccgcagucggcguccagcggcucugcuuguucgugugugugucguugcaggccuuauucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9365 - RNA, 3568 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9366 - RNA, 3268 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9367 - RNA, 3679 nt, Artificial Sequence
  Cas9 variant mRNA product
gggagagucccgcagucggcguccagcggcucugcuuguucgugugugugucguugcaggccuuauucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9368 - RNA, 4237 nt, Artificial Sequence
  Cpf1 variant mRNA product
gggagagucccgcagucggcguccagcggcucugcuuguucgugugugugucguugcaggccuuauucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9369 - RNA, 4216 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9370 - RNA, 4530 nt, Artificial Sequence
  Cas9 variant mRNA product
gggagaggcgcugccuacggagguggcagccaucuccuucucggcaucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9371 - RNA, 5313 nt, Artificial Sequence
  Cas9 variant mRNA product
gggagaggcgcugccuacggagguggcagccaucuccuucucggcaucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9372 - RNA, 3585 nt, Artificial Sequence
  Cas9 variant mRNA product
gggagaggcgcugccuacggagguggcagccaucuccuucucggcaucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9373 - RNA, 4653 nt, Artificial Sequence
  Cas9 variant mRNA product
gggagaggcgcugccuacggagguggcagccaucuccuucucggcaucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9374 - RNA, 3729 nt, Artificial Sequence
  Cas9 variant mRNA product
gggagaggcgcugccuacggagguggcagccaucuccuucucggcaucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9375 - RNA, 4590 nt, Artificial Sequence
  Cas9 variant mRNA product
gggagaggcgcugccuacggagguggcagccaucuccuucucggcaucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9376 - RNA, 3672 nt, Artificial Sequence
  Cas9 variant mRNA product
gggagaggcgcugccuacggagguggcagccaucuccuucucggcaucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9377 - RNA, 4428 nt, Artificial Sequence
  Cas9 variant mRNA product
gggagaggcgcugccuacggagguggcagccaucuccuucucggcaucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9378 - RNA, 4461 nt, Artificial Sequence
  Cas9 variant mRNA product
gggagaggcgcugccuacggagguggcagccaucuccuucucggcaucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9379 - RNA, 3594 nt, Artificial Sequence
  Cas9 variant mRNA product
gggagaggcgcugccuacggagguggcagccaucuccuucucggcaucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9380 - RNA, 3672 nt, Artificial Sequence
  Cas9 variant mRNA product
gggagaggcgcugccuacggagguggcagccaucuccuucucggcaucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9381 - RNA, 3678 nt, Artificial Sequence
  Cas9 variant mRNA product
gggagaggcgcugccuacggagguggcagccaucuccuucucggcaucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9382 - RNA, 3378 nt, Artificial Sequence
  Cas9 variant mRNA product
gggagaggcgcugccuacggagguggcagccaucuccuucucggcaucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9383 - RNA, 3789 nt, Artificial Sequence
  Cas9 variant mRNA product
gggagaggcgcugccuacggagguggcagccaucuccuucucggcaucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9384 - RNA, 4347 nt, Artificial Sequence
  Cpf1 variant mRNA product
gggagaggcgcugccuacggagguggcagccaucuccuucucggcaucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9385 - RNA, 4326 nt, Artificial Sequence
  Cpf1 variant mRNA product
gggagaggcgcugccuacggagguggcagccaucuccuucucggcaucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 9386 - RNA, 4582 nt, Artificial Sequence
  Cas9 variant mRNA product
ggggcgcugccuacggagguggcagccaucuccuucucggcaucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9387 - RNA, 5365 nt, Artificial Sequence
  Cas9 variant mRNA product
ggggcgcugccuacggagguggcagccaucuccuucucggcaucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9388 - RNA, 3637 nt, Artificial Sequence
  Cas9 variant mRNA product
ggggcgcugccuacggagguggcagccaucuccuucucggcaucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9389 - RNA, 4705 nt, Artificial Sequence
  Cas9 variant mRNA product
ggggcgcugccuacggagguggcagccaucuccuucucggcaucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9390 - RNA, 3781 nt, Artificial Sequence
  Cas9 variant mRNA product
ggggcgcugccuacggagguggcagccaucuccuucucggcaucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9391 - RNA, 4642 nt, Artificial Sequence
  Cas9 variant mRNA product
ggggcgcugccuacggagguggcagccaucuccuucucggcaucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9392 - RNA, 3724 nt, Artificial Sequence
  Cas9 variant mRNA product
ggggcgcugccuacggagguggcagccaucuccuucucggcaucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9393 - RNA, 4480 nt, Artificial Sequence
  Cas9 variant mRNA product
ggggcgcugccuacggagguggcagccaucuccuucucggcaucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9394 - RNA, 4513 nt, Artificial Sequence
  Cas9 variant mRNA product
ggggcgcugccuacggagguggcagccaucuccuucucggcaucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9395 - RNA, 3646 nt, Artificial Sequence
  Cas9 variant mRNA product
ggggcgcugccuacggagguggcagccaucuccuucucggcaucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9396 - RNA, 3724 nt, Artificial Sequence
  Cas9 variant mRNA product
ggggcgcugccuacggagguggcagccaucuccuucucggcaucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9397 - RNA, 3730 nt, Artificial Sequence
  Cas9 variant mRNA product
ggggcgcugccuacggagguggcagccaucuccuucucggcaucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9398 - RNA, 3430 nt, Artificial Sequence
  Cas9 variant mRNA product
ggggcgcugccuacggagguggcagccaucuccuucucggcaucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9399 - RNA, 3841 nt, Artificial Sequence
  Cas9 variant mRNA product
ggggcgcugccuacggagguggcagccaucuccuucucggcaucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9400 - RNA, 4399 nt, Artificial Sequence
  Cpf1 variant mRNA product
ggggcgcugccuacggagguggcagccaucuccuucucggcaucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9401 - RNA, 4378 nt, Artificial Sequence
  Cpf1 variant mRNA product
ggggcgcugccuacggagguggcagccaucuccuucucggcaucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9402 - RNA, 4484 nt, Artificial Sequence
  Cas9 variant mRNA product
gggagagucccgcagucggcguccagcggcucugcuuguucgugugugugucguugcaggccuuauucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9403 - RNA, 5267 nt, Artificial Sequence
  Cas9 variant mRNA product
gggagagucccgcagucggcguccagcggcucugcuuguucgugugugugucguugcaggccuuauucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9404 - RNA, 3539 nt, Artificial Sequence
  Cas9 variant mRNA product
gggagagucccgcagucggcguccagcggcucugcuuguucgugugugugucguugcaggccuuauucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9405 - RNA, 4607 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9406 - RNA, 3683 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9407 - RNA, 4544 nt, Artificial Sequence
  Cas9 variant mRNA product
gggagagucccgcagucggcguccagcggcucugcuuguucgugugugugucguugcaggccuuauucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9408 - RNA, 3626 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9409 - RNA, 4382 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9410 - RNA, 4415 nt, Artificial Sequence
  Cas9 variant mRNA product
gggagagucccgcagucggcguccagcggcucugcuuguucgugugugugucguugcaggccuuauucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9411 - RNA, 3548 nt, Artificial Sequence
  Cas9 variant mRNA product
gggagagucccgcagucggcguccagcggcucugcuuguucgugugugugucguugcaggccuuauucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9412 - RNA, 3626 nt, Artificial Sequence
  Cas9 variant mRNA product
gggagagucccgcagucggcguccagcggcucugcuuguucgugugugugucguugcaggccuuauucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9413 - RNA, 3632 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9414 - RNA, 3332 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9415 - RNA, 3743 nt, Artificial Sequence
  Cas9 variant mRNA product
gggagagucccgcagucggcguccagcggcucugcuuguucgugugugugucguugcaggccuuauucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9416 - RNA, 4301 nt, Artificial Sequence
  Cpf1 variant mRNA product
gggagagucccgcagucggcguccagcggcucugcuuguucgugugugugucguugcaggccuuauucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9417 - RNA, 4280 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9418 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9419 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9420 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9421 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9422 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9423 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9424 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9425 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9426 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9427 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9428 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9429 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9430 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9431 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9432 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9433 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 9434 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9435 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9436 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9437 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9438 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9439 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9440 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9441 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9442 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9443 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9444 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9445 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9446 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9447 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9448 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9449 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9450 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9451 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9452 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9453 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9454 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9455 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9456 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9457 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9458 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9459 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9460 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9461 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9462 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9463 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9464 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9465 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 9466 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9467 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9468 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9469 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9470 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9471 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9472 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9473 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9474 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9475 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9476 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9477 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9478 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9479 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9480 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9481 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9482 - RNA, 4433 nt, Artificial Sequence
  Cas9 variant mRNA product
gggagagucccgcagucggcguccagcggcucugcuuguucgugugugugucguugcaggccuuauucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9483 - RNA, 5216 nt, Artificial Sequence
  Cas9 variant mRNA product
gggagagucccgcagucggcguccagcggcucugcuuguucgugugugugucguugcaggccuuauucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9484 - RNA, 3488 nt, Artificial Sequence
  Cas9 variant mRNA product
gggagagucccgcagucggcguccagcggcucugcuuguucgugugugugucguugcaggccuuauucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9485 - RNA, 4556 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9486 - RNA, 3632 nt, Artificial Sequence
  Cas9 variant mRNA product
gggagagucccgcagucggcguccagcggcucugcuuguucgugugugugucguugcaggccuuauucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9487 - RNA, 4493 nt, Artificial Sequence
  Cas9 variant mRNA product
gggagagucccgcagucggcguccagcggcucugcuuguucgugugugugucguugcaggccuuauucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9488 - RNA, 3575 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9489 - RNA, 4331 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9490 - RNA, 4364 nt, Artificial Sequence
  Cas9 variant mRNA product
gggagagucccgcagucggcguccagcggcucugcuuguucgugugugugucguugcaggccuuauucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9491 - RNA, 3497 nt, Artificial Sequence
  Cas9 variant mRNA product
gggagagucccgcagucggcguccagcggcucugcuuguucgugugugugucguugcaggccuuauucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9492 - RNA, 3575 nt, Artificial Sequence
  Cas9 variant mRNA product
gggagagucccgcagucggcguccagcggcucugcuuguucgugugugugucguugcaggccuuauucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9493 - RNA, 3581 nt, Artificial Sequence
  Cas9 variant mRNA product
gggagagucccgcagucggcguccagcggcucugcuuguucgugugugugucguugcaggccuuauucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9494 - RNA, 3281 nt, Artificial Sequence
  Cas9 variant mRNA product
gggagagucccgcagucggcguccagcggcucugcuuguucgugugugugucguugcaggccuuauucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9495 - RNA, 3692 nt, Artificial Sequence
  Cas9 variant mRNA product
gggagagucccgcagucggcguccagcggcucugcuuguucgugugugugucguugcaggccuuauucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9496 - RNA, 4250 nt, Artificial Sequence
  Cpf1 variant mRNA product
gggagagucccgcagucggcguccagcggcucugcuuguucgugugugugucguugcaggccuuauucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9497 - RNA, 4229 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 9498 - RNA, 4735 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9499 - RNA, 5518 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9500 - RNA, 3790 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9501 - RNA, 4858 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9502 - RNA, 3934 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9503 - RNA, 4795 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9504 - RNA, 3877 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9505 - RNA, 4633 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9506 - RNA, 4666 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9507 - RNA, 3799 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9508 - RNA, 3877 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9509 - RNA, 3883 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9510 - RNA, 3583 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9511 - RNA, 3994 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9512 - RNA, 4552 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9513 - RNA, 4531 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9514 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9515 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9516 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9517 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9518 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9519 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9520 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9521 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9522 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9523 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9524 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9525 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9526 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9527 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9528 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9529 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9530 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9531 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9532 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9533 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9534 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9535 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9536 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9537 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9538 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9539 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9540 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9541 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9542 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9543 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9544 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9545 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9546 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9547 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9548 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9549 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9550 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9551 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9552 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9553 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9554 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9555 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9556 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9557 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9558 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9559 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9560 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9561 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9562 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9563 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9564 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9565 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9566 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9567 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9568 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9569 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9570 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9571 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9572 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9573 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9574 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9575 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9576 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9577 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9578 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9579 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9580 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9581 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9582 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9583 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9584 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9585 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9586 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9587 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9588 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9589 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9590 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9591 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9592 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9593 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9594 - RNA, 4732 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9595 - RNA, 5515 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9596 - RNA, 3787 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9597 - RNA, 4855 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9598 - RNA, 3931 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9599 - RNA, 4792 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9600 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9601 - RNA, 4630 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9602 - RNA, 4663 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9603 - RNA, 3796 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9604 - RNA, 3874 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9605 - RNA, 3880 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9606 - RNA, 3580 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9607 - RNA, 3991 nt, Artificial Sequence
  Cas9 variant mRNA product
gggagagcggcucggccauuuugucccagucaguccggaggcugcggcugcagaaguaccgccugcggaguaacugcaaagaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9608 - RNA, 4549 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9609 - RNA, 4528 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9610 - RNA, 4525 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9611 - RNA, 5308 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9612 - RNA, 3580 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9613 - RNA, 4648 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9614 - RNA, 3724 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9615 - RNA, 4585 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9616 - RNA, 3667 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9617 - RNA, 4423 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9618 - RNA, 4456 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9619 - RNA, 3589 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9620 - RNA, 3667 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9621 - RNA, 3673 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9622 - RNA, 3373 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9623 - RNA, 3784 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9624 - RNA, 4342 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9625 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9626 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9627 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9628 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9629 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9630 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9631 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9632 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9633 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9634 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9635 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9636 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9637 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9638 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9639 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9640 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9641 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9642 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9643 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9644 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9645 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9646 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9647 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9648 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9649 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9650 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9651 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9652 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9653 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9654 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9655 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9656 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9657 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9658 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9659 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9660 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9661 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9662 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9663 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9664 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9665 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9666 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9667 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9668 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9669 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9670 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9671 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9672 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9673 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9674 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9675 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9676 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9677 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9678 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9679 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9680 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9681 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9682 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9683 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9684 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9685 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9686 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9687 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9688 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9689 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9690 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9691 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9692 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9693 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9694 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9695 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9696 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9697 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9698 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9699 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9700 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9701 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9702 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9703 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9704 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9705 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9706 - RNA, 4522 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9707 - RNA, 5305 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9708 - RNA, 3577 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9709 - RNA, 4645 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9710 - RNA, 3721 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9711 - RNA, 4582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9712 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9713 - RNA, 4420 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9714 - RNA, 4453 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9715 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9716 - RNA, 3664 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9717 - RNA, 3670 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9718 - RNA, 3370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9719 - RNA, 3781 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9720 - RNA, 4339 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9721 - RNA, 4318 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 9722 - RNA, 4741 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9723 - RNA, 5524 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9724 - RNA, 3796 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9725 - RNA, 4864 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9726 - RNA, 3940 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9727 - RNA, 4801 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9728 - RNA, 3883 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9729 - RNA, 4639 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9730 - RNA, 4672 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9731 - RNA, 3805 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9732 - RNA, 3883 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9733 - RNA, 3889 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9734 - RNA, 3589 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9735 - RNA, 4000 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9736 - RNA, 4558 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9737 - RNA, 4537 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9738 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9739 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9740 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9741 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9742 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9743 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9744 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9745 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9746 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9747 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9748 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9749 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9750 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9751 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9752 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9753 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9754 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9755 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9756 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9757 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9758 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9759 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9760 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9761 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9762 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu
